United States Patent 12,371,699 (NUCLEIC ACIDS ENCODING CRISPR-ASSOCIATED PROTEINS AND USES THEREOF) - sequence listing, part 6

SEQ ID NO: 4430 - RNA, 4188 nt, synthetic construct
  misc_feature 1..4188: note = Cas9 variant
  source 1..4188: mol_type = other RNA
atgagcttcaagaaaatcctgggcctcgacgtgggggtcgcctccattggatgggctgttgtgagagagaacgaagagaatcccaactttaataccatcacaaagctgggcgtgcgggtcgtgcctattacgtctgatgaaaaacttaacttcgagaaggggaaaagcatcacctccaatgccgaacgcacactggcgagatctagccggcgcaacctccagagatttcggctgcgcagaaagaatcttattgctatcctgctccaaaaccagatcattaccccgacaacacccctgacagagaagggaaaattcaccacgtttgagaccctgaagatccgggccaaagccacaaaggagaaaattgaactcgaggagctggctcgcgttcttctgcacatcaataagaagagaggctacaaatcctctcggaaggtgaaaaacagcgaggacgggaaggccattgatggaatggaagctgccaaaatcctctatgagaataagctgacccctggccagtacacatatcagcttctggaaaaaggctccaacaagattcccgacttctactgcagcgatctccaaatcgagtgggaagtcatctggaattttcagaagcagttctatcctaacctgctgaccgaggactttaaaaaggagctcaaagggattggacagcgcgcgacggccgctctgttccttaagaaatacggcatctatacagccctgaataaggggaagagagaagagaaaaagctccaggcttacaaatggcggtctaagtccgtgagcgagaaaattcccgttgaagaactggcctacgtgatcgcggagattaactctcatatcaccaactccagcggatatcttggcacaatctctgatcgctccaaggagctgtactttaatcagcagaccattggggaaaacctctatgcccaggtcgctaagaatacccacgccaaactgaagaaccaagtgttcctgagacaggactacagcgctgagtttgaacagatctgggagacacaagccaaattccatcctcagctcacgccggaactgaagaaaaagattcgggattccatcattttctatcagagaaaacttcgctctcagaaacggctgatcagcatctgtgagtttgagaatagagaaattgagatcattaagaacggcaaaaagaaaaagaaaaagatcggactcaaggccgctcccaaatccagccctctgttccaagaatttaagatttggcaagtgcttaataacatcgtcattaaacaggagggcaaggaccgcctgctcacctgggaggaaaaagagctgctgttcacagaactcaatatcaaggggaacatctctggacagaaggcgctggcccttctgaaactctcccccaaggataccaagattaatgttacaatcctggaaggcaaccacacccaggaacaactgtaccgggtgtatcttcgcattctcgggatggagggatacgacgtgtttgatctgctgaagatccctgagaatcaggacgaaattaaacccgctgacagcaagatctctgccgccgagatcaaggaaacggtcaaaagcgtgttcaagacatgctccatttctccgagcatcctcgattttgaccctctgcttcccaaccctgagttcgaaaatcagtccagctaccaactgtggcatctcctgtattcttacgagggcgattccagcccctctgggaacgagaaactgcttgaactcctgaagaacaaatttggattcaagaaggagcacgctctgctcctggcctccattagctatacctacatctatggcaatctttcctctaaagcgatgagaaagatttacccctatagcaaagaaaacacctactccgaggcttgtatgctggccggctaccggcactctaagaatgccctccctagagaggaactggttaaatatcagctgaaggaccgccttgagatcctcccgaaaaacagcctgcggaatcccgtggtcgaaaaggtgctgaaccagctcatcaatctggttaactcccttatggatgagtacggggcttttgacgaaattagactggagatggcccgcgagctcaagaaaaatgctaaggaacgggagaaatggagcaagaacatcgccgatgcgacatctagaaatcagaaacatgccgaaattctgaagaaggacttcaaaatctccaaccctagcaagaatgatctgattcggtatcgcctttacctcgagctgaaagctaacggatataatgacctgtacaccaacacatatatcgatatcaactacctctttacgcacagatacgacattgaccatatcattccccaatctaaggtgctggatgactccttcagcaataaagtccttgtgcctcggcaggccaacctggaaaagtctaatctcaccgctttcgattatatcagccaccagggcaaggagaaagaggaacactacctgaacgtcattacagagctgtataagagagggtccatcagcgaaaccaaatacaagaatcttcagaaaaagggaaacgagattggcgaagggtttatcaatcgcgacctgaagaacacacaatatatcgtgcggaaagccagagagattctctctctgatcacccccaatgttgtgacgaccacaggcgagattaccgcgaagctccgcaaagattggaacctgatcaattccatgaaggaacttaacatggacaaattcagaaatgcccggctgacagagctcgtcgaaaacagccgcggagagaagaaggaaattatcatcgattggaataaaagaaacgaccagcggcatcacgctattgatgccctggtggttgcttttaccacgcgcaaccatgtgcagtacctgaattatatgaacgccagagaggacgagtcccacaagcaacattctcacatccttagcattgagaaaaagatcaaatacgataagttccacgaaaatggctcccggcagtctcgctttatttacccgacaagcaacttcagagaagaggccaaaaagaagctgaaagagatcctcgtctcctataagaccaaaaataaggtggtgacagttaacatcaataaacctaagaagaaagggggatactctcccaagcatgaactgacccctcggggccccctccacaaagagaccatttatgggatgatccgcattctgcatacaaaggaaatcaaagtcagctccaaacttaactttgagacggtggtgcggattcagaatcctagatacagaaacgctctgctcgaacgcctgaaggacaatttcaacgatcccaagaaggcgtttagcggaaccaattctctgaccaaaaacccggtcttccttaccgccaattccacagagaccgtgcctgagaaggttacgatccagtggtttgaaaaagtgtatacaattcggaagcccatcaaccccaccaatttcaagaacgagaaaaacatcgaaaaggtcctggaccctaccattagaacactcctgaaaaagcgcctccaagagtacaatggcaacgctaaagaagcctttagcgacctggagaagaatccgatctggcttaaccaggagaaagggatttgcatcaagaccgtgacaattacgggcatctctaatgttgaatccctgcacaccaagaaagatcacttcggaaaggagctgctcgacatcaacggcaatcccattcctgtggatttcgtcagcacagggaacaatcatcacgtggccatctatgaagactctgagggaaacctgcaggaaaaagttgtgtccttttacgaggctgtcgagcgggtgaatcagggccttcccgtgattgataccctgtacaacctcgacctggggtggaagttcctctttacaatgaaacaaaatgaaatgttcctgtttcctgccgatgacttcgatcccaacgacatcgatatttatgacgagaagaatcttatcctgatcagcaagcatctgtttagagtccagaaactctccagcaaggattactgtttccgccaccatctggaaacctctattaactttaacgaccctgcgcttaaaggaatcacgtggcggagagagagccccaatggcctgcgcaacctcgttaaggtgcggctgaatcacctcgggaaaattgtgcacatcggcgagtga

SEQ ID NO: 4431 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaaccacaaagacctgtgggggatgagatgctttgaaaccgccgagacagcggaaaagcggcgcctcttcagaggagctcggcgcagaattgagcggcgcagaaagcggatcaaactgcttcaggaactgttttcccaagagattgccaagatcgatgaggacttctttcagcgcatggaagagtctcccttctacgccgaagataaaaccattctccaggagaatacactgtttaacgacagagatttcaccgacaagacatatcataaggcttaccctaccatcaatcacctgatcaaggcctggattgagaacaaggtgaaaccggatccccggctcctgtatcttgcttgtcataatatcattaagaaacgcggccactttctgttcgaaggggactttgatagcgagaaccagttcgacacgtccgtgcaagccctctttgaatacctgagagaggacatggaacttgatatcgacgcggattctaagaaaattaaggagatcctgaaagacagcgccctcaaaaattccgataagcagaaccggctgaataaactgctcggactgaagtctagcgacaaacagaagaaagctcttaccaacctgatttccggcaataaggccaacttcgctgatctctatgacaatcctgatctgaaggacgccgagaaaaacagcatctctttctccaaggatgactttgacgcgcttagcgatgaactggcctctgtcctcggcgactccttcgagctgctgctccgcgctaaagccgtgtacaattgcagcgttctgtctaaggtgatcggggatgaacagtacctttcctttgctaaagtcaagatttatgagaagcataaaaacgacctgacaaagctcaaagaagtggttaagaaatacttccccatcgagtatagaaacatttttggatacaagcaaagcgagaataacaattgtaactattcccggtacgtgggcgtctgcaagtctgggagcaaaaagaaagtgatcaataagaccgcctcccaggaagatttctataaatttctgaaggacattcttctgaaaagaagcgatgtgcctgaggccaacggaatcctcacagaaatcgagaccggcacgttcctgcccaagcagatttctaagaataacgctgaaatcccttaccagctgcgcaaaattgagctcgagaagatcctgacaaatgcggaaaaatttttctcctttcttaagcaaaaagacgagaacgggctgagccactctgaaaagattatcatgctcctgaccttcaagatcccgtactatattggacccatcaatacaagccacaaacagtactttcctgatcggtcctgggtcattaagaaagagaacgctccccaggagaagatcaccccttggaatttcttcgaccatattgataaagaaaagaccgccgaggcctttatcacatctagaacgaacttctgtacctatctgattggcgaaagcgttcttcccaaaaattccctcctgtacagcgagtatacagtgctgaacgaaatcaacaatctccaaatcattatcgacggcaagaacatttgcgatgtgaagctgaaacagaagatctacgaggagctttttaaaaagtataagaaagtcacccagaagcagatttctacattcatcaaacacgaagggatctgtaataagaccgacgaggtgattatcctgggaattgacaaagaatgcacgtccagcctcaagtcttacatcgagctgaaaaacatttttggcaagcaagttgatgaaatctccacaaagaatatgctggaggacatcattcgctgggccaccatctacgatgagggggaaggaaaaaccattcttaagacaaaaatcaaggctgagtatgaaaaatactatagcgacgagcagattaagaagatcctcaacctgaaactgtccggctgggggcggctctctagaaagttcctggaaagcatcacctccgagattccgggatttatcgagcctgtgaatattatcacagccatgcgcgaaacgcagaacaatcttatggagctgctctctagcaaattcaagtttaacgaaaatattaaaaagatcaactccggcttcgaggataccgacaagcggtttagctacaattctctggtcaaacccctgttcctttcccctagcgtgaagaaaatgctctggcagacactgaagctggttaaagagatttctcatatcacccaagcgcctcccaagaagatctttattgaaatggctaaaggcgccgagctcgaacccgccagaacaaagacccgcctgaaaatccttcaggatctgtataactcctgtaagaatgacgctgatgccttcagctctgagattcagtacctcctggggaaaatcgaaaacgaggacaacctgcggcttagaagcgataagctctatctgtactacacgcagctgggaaagtgcatgtattgtggcaaaccgattgagatcgggcacgtgttcgacacctccaagtacgatatcgaccacatttatccccaaagcaaaatcaaggacgattctattaataaccgcgtcctcgtgtgctccagctgcaataaaaacaaggaagacaaataccctctgaagcccgagatccagcttaagcagaaaaagttttggaatttcctgcagcggaacaattttatttccatcgaaaaattcaacagactcacacggaccacacctatctctgatgacgagaccgctaagtttattgcccgccaactggtcgaaacgagacaggcgacaaaagtggccgctaaggttctggagaagatcttccccgagaccaatattgtgtatagcaaagccgaaacagtctccatgtttcggaacaagttcgatatcattaaatgtagagagatcaatgactttcatcacgctcatgatgcctaccttaacattgtggttggaaatgtgtataacaccaagttcaccaataacccgtggaactttatcaaagaaaagcgcgacaatcctaagatcggcgatacatacaactactataaagtcttcgactacgatgtgaagcggaataacattacggcgtgggagaaagaaaagaccatcattacagtgaaaaccatgctgaagagaaatacacccatctatacccgccaggccgcttgcaagaaaggggaactcttcaaccaaacgattatgaagaaaggcctgggacagcaccctctcaagaaagagtgtcccttttctaatatcagcaagtacggcgggtataacaaagtttccgccgcttactatacattcatcgagtacgaggaaaagggaaataagattagatctctggagaccatccctctttacctggagaaagacattcaaaagagccaggacggcctcaaagggtatctgaccgatcagctgggaaagaaagaaatcaagattcttgtccccaagatcaaaatcaactccctgctcaagattaatggctttccgtgccatatcacagggaaaaccggcgccagcttcgtgctgcggcctgccgtgcagttttgttgctctaacgacgaggtcctctacttcaagaaaattatccgctttaatgaaattagatcccagcgggagaagatgggaaagacaatcagcccctatgaagatctgtctttccgctcctacattaaagagaacctttgtaagaaaacgaagaatgacgagatcggcgaaaaagagttttatgggttcctgcagaagaagaacctcgaaatctacgatatgctgctgattaaacacaaggacaccatctatagcaaaagacccaattctacaacccttgatatgctgattaagggacggtacgagtttatcaacctcaaacctgaagaccaaattcgcgtgatgctggagatcctcaagctgttctgcacaaccagagaggttatcgatcttggcctgattaaagggaagtccgaagctggagtgacgaccctgggcaagaaaatcagcaacctcgactcctgtattctgatctaccagagcattacagggatctttgagaagcggatcgatcttctgaaaatttga

SEQ ID NO: 4432 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagaccgatgagggctttttccagcgcatgaaagaatctcccttttacgccgaggacaagacaatcctccaggaaaatgctctgttcaacgatagagactttaccgataaaacatatcataaggcctaccctaccattaatcacctgatcaaggcttggatcgagaacaaagtgaagccggacccccggctcctgtatcttgcctgtcataatattatcaaaaagcgcgggcacttcctgtttgagggagatttcgacagcgaaaaccagtttgatacgtccattcaagcgctgttcgagtacctgagagaagacatggaggtcgacatcgatgccgactctcagaaagtgaaggaaattcttaaagatagctccctgaagaatagcgagaagcagagccggctcaacaaaatgctgggcctgaagccttccgacaaacagaagaaagctatcaccaatctcattagcggcaacaagatcaattttgccgatctgtatgacaaccccgatcttaaggacgctgagaaaaattctatctccttcagcaaggatgacttcgatgccctgtctgacgacctcgcgtccattctgggggatagctttgaacttctgctcaaagccaaggctgtttacaactgctctgtgctgtccaaagtcatcggagacgagcaatacctgagcttcgccaaggtgaagatttatgaaaaacataagacagatctcaccaaactgaagaatgttatcaaaaagcactttcctaacgactacaagaaagtgttcggctataacaagaatgagaaaaacaataacaattactccgcttatgtcggggtgtgtaagacaaaatctaagaaacttgtgattaacaataccgtcaaccaggaagatttttacaagttcctgaagcccatcctcctggccaaaagcgagatcaaggaggttaatgacattcttacggaaatcgagacaggaacctttctgcctaaacagatttccaagagcaacgccgaaatcccgtatcagctccgcaaaatggagctggaaaagattctgtctaatgctgagaagcacttctcctttctcaaacaaaaggatgagaaaggcctgagccattctgaaaagatcatcatgcttctgacattcaaaattccctactacatcgggcctattaacgacaatcacaagaagtcttttcccgatagatgctgggtgatcaaaaaggagaaatccccttctggaaagaccaccccctggaacttctttgaccatattgataaagacaagacagcggaagccttcatcacgagccggaccaatttctgtacatatctcgtgggcgagtccgtcctgccgaagaacagcctgctttactctgagtataccgtgctcaacgaaattaataacctgcagatcatcattgatggcaaaaatatctgcgacattaagctgaaacagaagatctacgaggaactctttaaaaagtataaaaagattacacaaaagcagatctccaccttcatcaaacacgaggggatttgtaacaagacggacgaagttatcattctgggaatcgataaagagtgcacaagctctcttaagtcctacattgagctgaaaaatatctttggcaaacaggtggacgaaatcagcaccaagaacatgctcgaggaaattatcagatgggctaccatttatgatgagggggaaggaaagacaatcctgaagaccaaaattaaggccgagtacggcaaatactgttccgacgagcagatcaagaagatcctgaatcttaaattctctgggtggggacgcctcagccggaagtttctggaaacagtcacgtccgagatgcctggcttctctgaacccgtgaacattatcaccgccatgagagagacacaaaataacctgatggaactcctgagctccgagtttaaattcaccgagaatattaagaaaatcaacagcggctttgaagatgttgagaagcagttctcttatgactcccttgtgaagcctctgtttctcagcccctctgtcaaaaagatgctgtggcagacactgaaacttgtgaaggaaatttcccacatcacccaggctccccctaaaaagattttcatcgagatggccaagggggcggagctcgatccggtccgcacgaaaacccggctgaagatcctgcaagacctctacaataactgcaaaaatgatgctgacgcctttagctctgaaattaaggatctgagcggaaaaatcgagaacgaagacaaccttagactgcgctccgataagctctatctgtactatacacagctgggcaaatgtatgtactgcgggaagcccattgagatcggacatgtgttcgacaccagcaattatgacattgatcacatctaccctcagtctaagatcaaagacgattccattagcaaccgggttcttgtgtgctcctcttgtaataagaacaaagaagacaagtaccccctcaaagccgagatccagagcaagcaaagaggcttctggaattttctgcagcgcaacaatttcatttccctggagaagctcaaccggctgacaagaacctctcctatcagcgatgacgaaacggctaaatttattgcccgccagcttgtcgagacacggcaggctaccaaggtggccgcgaaagttctggaaaagatgttccccgagacaaaaatcgtgtattccaaggccgaaaccgtctctatgtttagaaataagttcgatatcattaaatgccgggagatcaacgactttcatcacgctcatgatgcctacctcaatattgtggtggggaacgtttataataccaagttcacaaacaatccgtggaactttatcaaagagaagcgcgacaaccctaaaattgctgatacgtacaattattacaaggtcttcgactatgacgtgaagagaaacaatatcaccgcctgggaaaaaggcaagacaattatcaccgtgaaagatatgctgaagcggaacacacccatctacaccagacaagcggcctgtaaaaagggagagctgtttaatcagacgattatgaaaaagggccttgggcagcaccctctgaagaaagaaggacccctcagcaacatctccaagtacggcgggtataataaagtcagcgctgcctactatacactgattgagtacgaagagaagggatctaaaatccgctccctcgagaccattcctctgtatcttgtgaaggacatccaaaagaacaaagatggcctcaagagctacctcaccgaccagatcgggaaaaaggaaattaaaatcctgattcccaagatcaagattaattctctgcttaaaatcaacggcttcccgtgccacatcacaggaaagatgggcgaggctttcgttctgcggcctgccgtgcagttttgttgctccaatgatgaagccctctatttcaaaaagattatcagatttaacgagattcgcaaacagagagagaagatggggaagaccatcagcccctacgaagacctgtctttccggtcctacattaaagataatctctgtaagaaaacaaaggctgacgagatcgaagagaaagaattttatgatctgcttcaaaagaaaaacctggagatttacgacatgctcctgacgaagcataaggataccatctataaaaagcgccccaatagcgcgacaatcgacattctggtcaaaggaaaggagaaattcaagtcccttatcattgaaaaccagtttgaggtgatcctggaaattctcaagctgttcagcgccaccagaaatgtttctgatctccagcacatcggcgggagcaaaaacgctggaaacgcccgggtgggcaataagatctcctctctggacaactgcattcttatctaccagagcattacagggatctttgagaaacgcattgacctgctgaagatctga

SEQ ID NO: 4433 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagatcgatgagggctttttccagcgcatgaaagaatctcccttttacgccgaggacaagaccattctccaggaaaatgctctgttcaacgataaagactttacagataagacctatcataaggcctaccctacaatcaatcacctgatcaaggcttggattgagaacaaggtgaaaccggaccccagactcctgtatcttgcctgtcataatatcattaagaaacgggggcacttcctgtttgagggagatttcgacagcgaaaaccagtttgatacctccatccaagccctcttcgagtacctgcgcgaagacatggaggtcgacattgatgccgactctcagaaggtgaaagaaatccttaaggatagctccctgaaaaattctgagaaacagagcagactcaacaagattctgggcctgaaaccttccgacaagcagaaaaaggctatcacgaatctcatcagcggcaacaagattaattttgccgatctgtatgacaaccccgatcttaaagacgctgagaaaaattctatctccttcagcaaagatgacttcgatgccctgtctgacgacctcgcgtccattctgggggatagctttgaacttctgctcaaggccaaagctgtttacaactgctctgtgctgtccaaggtcatcggagacgagcaatacctgagcttcgccaaggtgaaaatttatgaaaagcataaaaccgatctcacaaagctgaaagctgttatcaagaagcactttcctaataactacaaaaaggtgttcggctataaccaggacaatgagtccaaaaacaattactctgggtatgtcggagtgtgtaagaccaaaaacaagaaacttgtgatcaataacagcgtcaatcaggaagatttttacaagttcctgaagcccattctctccgccaaaagcgagatcaaggaggttaacgacattctggccgaaatcgagacaggcaattttcttcctaaacagatttctaagtccaacgctgaaatcccgtatcaactgcggaaaatggagctcgaaaagatcctgagcaatgcggagaagcacttctcttttctgaaacagaaggatgagaaagggctcagccattccgaaaagattatcatgctgcttaccttcaaaattccctactacatcggacctattaacgacaatcacaagaagtcttttcccgatcgctgctgggtggtgaaaaaggagaaaagcccttccggcaagacgacaccctggaacttctttgaccatatcgataaagaaaagaccgccgaggagttcattacaagcagaaccaatttctgtacctatctgatcggcgaatctgtcctcccgaagaactccctgctgtacagcgagtatacagtgcttaacgaaatcaataacctccagattatcattgacgggaaaaatatctgcgatacgaagctgaaacaaaagatttacgaggacctgtttaaaaagtataaaaagatcacccagaagcagatctctacattcattaaacacgaaggaatctgtaacaagaccgacgaggttattatcctcggcattgataaagagtgcacatccagcctgaagtcctacatcgaacttaaaaatatctttgggaaacaggtggacgagatttctaccaagaacatgctggaagagatcattcggtgggctacgatctatgatgaaggagagggcaaaacaattctcaagaccaaaatcaaggccgagtacgggaaatactgtagcgacgaacaaatcaagaagattctgaatctgaaattctccggatggggcagactttctcgcaagtttctcgagaccgtcacaagcgaaatgcctggcttctccgagcccgtgaacatcattaccgccatgcgggaaacacagaataacctgatggagctgctcagctctgagtttaaattcacggaaaatatcaagaaaattaactccgggtttgaggatgctgaaaagcagttcagctatgacggactggttaagcctctttttctgtctccctccgtgaaaaagatgctctggcagaccctgaaactggtcaaggagatcagccacattacacaagcgccccctaaaaagatcttcatcgagatggcgaagggcgctgaacttgagccggccagaaccaaaacacgcctcaagattctgcaggatctgtactctagctgcaaaaatgacgccgatgctttttccagcgaaatccagtatctctctgggaagattgagaacgaagacaatctgcggcttagatccgataaactgtacctctattacacccagctgggaaagtgtatgtattgcggcaaacccatcgagattgggcatgtgttcgacacgagcaactacgatatcgaccacatctaccctcaatccaagattaaggacgattctatcagcaaccgcgtcctggtgtgctcctcttgtaataaaaacaaggaggacaaatatccccttaagagcgaaattcagtccaaacagcggggcttctggaattttctccagagaaacaatttcatctctctggagaagctgaaccgcctcacccggacaacccctattagcgatgacgaaacagccaagtttatcgctagacaactggttgagacccgccaggccacgaaagtggcggccaaggtccttgaaaagatgttccccgagacaaagatcgtgtactccaaagctgagaccgttagcatgtttcggaataagttcgatattatcaagtgcagagaaattaacgactttcatcacgcccatgatgcttatctgaatatcgtggtcggaaacgtgtacaatacaaaattcaccaacaatccgtggaactttattaaggagaaacgggacaatcctaagatcgccgatacctataactactataaagtgttcgactacgatgttaagcgcaacaatattacagcgtgggaaaagggcaaaacgatcatcaccgtcaaggacatgctcaaaagaaacacacccatttacacccggcaggccgcttgtaagaaaggggagctgtttaatcaaacaatcatgaagaaaggactgggccagcaccctcttaagaaggaagggcccttctctaacatttccaaatatggaggctacaataaggtgagcgccgcttattacaccctgatcgagtatgaggaaaaagtgaacaagattagatctctcgagacgatccctctgtacctcgtcaaagacatccagaaggatcaggacgtgctgaagtcctatcttacagatctgctcgggaaaaaggaaattaaaatcctggttcccaagattaaaatcaatagcctgcttaagattaacggcttcccgtgccacatcaccggaaagaccggcgactcttttgtgctgcgccctgccgtccaattctgttgctccaatgatgaggtgctctactttaaaaagatcattcggttcaacgagatcagaagccagcgcgaaaagatggggaagacaatttccccctacgaggacctgagctttagatcttatatcaaagaaaatctctgtaagaagaccaaagccgatgagattggagaaaaggagttctacgacctgcttcagaaaaagaacctggagatctatgatatgctcctgacaaaacataaggacacgatttacaataaacggcccaacagcaccacactgggcatgcttaccaaggggcgctatgaatttatcaatctgaagcctaaagatcagatcattgttatgctcgagatcctgaaactcttctgcacaaccagagaagctattgacctgggacttatcaagggcaagccggcggccggggtggctacgctgggcaaaaagatttccaacctggataattgtatcctcatctaccaatctattaccggaatctttgagaagcggattgacctgcttaaagtctga

SEQ ID NO: 4434 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagatcgatgagggctttttccagcgcatgaaagaatctcccctctacgccgaggacaagaccattctgcaggaaaatacactgtttaacgataaagacttcaccgataagacatatcataaggcttaccctaccatcaatcacctcatcaaagcctggattgagaacaaggtgaaaccggaccccagactgctttatctggcttgtcataatatcattaagaaacgggggcactttctcttcgagggagattttgacagcgaaaaccagttcgatacgtccatccaagccctgtttgagtaccttcgcgaagacatggaggtcgacattgatgcggactctcagaaggtgaaagaaatcctgaaggatagctccctcaaaaattctgagaaacagagcagactgaacaagatgctgggcctcaaaccttccgacaagcagaaaaaggccattaccaatctgatcagcggcaacaagatcaatttcgctgatctttatgacaaccccgatctgaaagacgccgagaaaaattctatttcctttagcaaagatgacttcgatgctctctctgacgacctggcctccatccttggggatagcttcgaactgctcctgaaggcgaaagccgtttacaactgctctgtgctgtccaaggtcattggagacgagcaatacctcagctttgctaaggtgaaaatctatgaaaagcataaaacagatctgaccaaacttaaaaatgttattaagaagcacttccctaaagactacaagaaagtgtttggctataacaagaacgagaaaaataacaataactactccgggtatgtcggagtgtgtaagacaaaatctaagaagctgatcatcaataacagcgtgaatcaggaagatttctacaaatttctcaagaccattctgtccgccaaaagcgagatcaaggaggtcaacgacattcttacggaaatcgagacaggcaccttcctgcccaaacagatttctaagtccaatgctgaaatcccttatcagctccggaagatggagctggaaaagatcctgagcaacgccgagaagcacttttctttcctcaaacaaaaggatgagaaagggctgagccattccgaaaagattatcatgcttctgacatttaagattccgtactacatcggacccattaatgacaaccacaaaaagtctttccctgatcgctgctgggttgtgaaaaaggagaaaagcccctccggcaagaccaccccttggaactttttcgaccatatcgataaggaaaagacagccgaggagtttattacgagcagaaccaatttctgtacatatctcatcggcgaatctgtgctgcccaaaaattccctgctttacagcgagtataccgtcctcaacgaaatcaacaatctgcagattatcattgacgggaaaaacatctgcgatacaaagctgaaacagaagatttacgaggaactcttcaaaaagtataagaaaatcacccaaaagcagatctctacgtttattaaacacgagggaatctgtaataagacagacgaggtgattatcctgggcattgacaaagaatgcacctccagccttaagtcctacatcgagctgaagaacatcttcgggaaacaggttgatgaaatttctaccaagaatatgctcgaggaaatcattcggtgggctacaatctatgacgagggagagggcaaaaccattctgaagacaaaaatcaaggcggaatacgggaagtactgtagcgatgagcagatcaaaaagattctgaaccttaaattttccggatggggcagactctctcgcaagttcctggaaacggtgaccagcgagatgccgggcttttccgaacctgtcaatatcattacagccatgcgggagacccaaaacaatctgatggagctcctgagctctgagttcaaatttacagaaaacatcaagaagattaattccgggttcgaagacgtggagaaacagtttagctatgatggacttgttaagcccctgttcctctctccttccgtgaaaaagatgctgtggcagaccctgaaacttgtcaaggagatcagccacattacgcaggctcctcccaagaaaatctttatcgaaatggccaagggcgccgagctcgaccccgtgagaaccaaaacacgcctgaagattctgcaagatctctacaacaattgcaaaaacgacgctgatgccttctctagcgaaatcaaggacctgtccgggaaaattgagaatgaagataaccttcggctgagaagcgacaagctctatctgtactatacccagctgggaaagtgtatgtactgcggcaaaccgatcgagattgggcatgtctttgatacatctaactatgacatcgaccacatctacccccagtccaagattaaagatgacagcatctccaatcgcgtgcttgtttgctctagctgtaacaagaataaagaggataagtaccctctcaaggcggaaattcagtccaaacaacggggcttctggaacttcctgcagagaaataactttatctctctggagaagttcaatcgcctcacccgggctacgcccattagcgacgatgaaacagccaaatttatcgccagacagctggtggagacccgccaggctacaaaggtcgccgctcgggtgcttgaaaagatgttccctgagaccaagatcgtttattccaaggccgagaccgtgtctatgtttagaaacaaattcgacattgtcaagtgccgggaaatcaatgattttcatcacgcgcatgacgcctacctgaacattgtggtgggaaatgtttataacacaaaattcacgaataacctctggaattttatcaaggagaaacgcgataaccccaagattgctgacacctacaactattacaaggtcttcgattatgacgtgaaaagaaataacatcacagcctgggaaaagggcaaaaccattatcacagtgaaggacatgctgaaacggaataccccgatctacacgagacaagctgcctgtaagaaagggggactgtttgatcagacaattatgaagaagggccttgggcagcaccctctgaaaaaggagggacccttcagcaacatctccaaatacggcgggtataataaggtcagcgcggcctactataccctcattgaatacgaggagaaaggcaacaagatccgctctctggaaaccattcctctctatctggtgaaggacatccaaaaagatcaggacgttcttaagtcctacctgacagatctcctgggaaagaaggagttcaaaatcctggtgcccaagattaagatcaatagccttctgaaaattaacggctttccttgccacatcaccgggaagacaaatgactctttcctcctgcggcccgctgtccagttttgttgctccaacgatgaagtgctctatttcaaaaagattatcagatttagcgagatccgctctcagagagagaaaattggaaagacgatctccccgtacgaagacctgagcttccggtcctacattaaggagaatctttgtaaaaagaccaaaaacgatgaaatcggcgagaaggaattttatgacctgctccagaaaaagaatctggagatttacgatatgctgcttacaaaacataaggacaccatctataagaaacgccctaacagcgccacaattgatatcctggttaaggggaaagagaagttcaaatctctcatcattgaaaatcaatttgaggtgatcctggaaattctcaagctgttcagcgctaccagaaacgtctccgaccttcagcacatcggaggctctaagtacagcggggtggccaaaattggcaataagatctcctctctggacaactgcatcctgatttatcagagcatcacgggaatttttgagaaacggatcgatctcctgaaggtttga

SEQ ID NO: 4435 - RNA, 4191 nt, synthetic construct
  misc_feature 1..4191: note = Cas9 variant
  source 1..4191: mol_type = other RNA
atggacagctccaagcagggcctgagacggtaccacctcgggctggatatcggaaccaactctattggctggacagccatcgacgatcatttcagccttctgcgcgtgaaagggaagaatgctattggagtcagaacgtttaaagagggcgaaaccgccgcggaccggcgcgggttcagaacagctcggcgcagactctcccggcgcagatggcggctgcaatttcttgatgagttctttgccccctatctggccgaagttgaccctaacttcctcgctcgcctgaagcagtctgatatcagcgccaaagacccggctaagaatcaggagtacatgggaaagctgctctttcccgatcaggaagccgcgtccgacggcaacggctatcctaccctgattcaaatgagaaaagccatgcccgctgagaaggccgctgatttccctgtgtttaatatctaccagcttcggtatgccctgatgaacgagaaacgcaagttcgacctcagagaaatctacctggcggtgcaccatattgtcaaatatcgggggaattttcttaacaatacatctgtggataagttcaaggccgaccagatcgactttaacaagagcttcgagaccctgaatgatctcttcagacaggttcaacccattgctccttttcagatcgacctgacaaaggtggatgaactgggaaaactcctgcttgacaccaagcagaaaaagctggatcgccagaaagccgtcgctaagctcctgccgcttattgaggacggcacggataaggagatcgtgaaagcccaccaacagaccgcccgggaaatttccaagctgatcctcgggtacaaagctaaggttggactgatcctgcagaacaatctcgaccaaacactggatatgagcaccgagaactctgacgatcagcttatgcagattgcggaagaactggacgactaccagatggaactcatcaatcaactgtcccttctgtatagccagattatgctcaacgagatcgtgcccaacggcgagacagtctctgcctccatgctgaatagatactataaacatcgctgccagctgaaggaactcaaggattacggggctgcccaggacaaaaagacccgggagcaactggatcacctttatgccgaatacattggacagatccctaaagacagcaagttcgattttacgaaagacctgaagaagctcatggataaatctgacctgggccagaagatcaaagatgagattgaagctggcgactatctgcccaagcagagaacatccgccaacggggtgatccctcaccaaatgcatcagcaggagcttgatcagattatcgagaatcaaaaagaatactacccctggctcgcggagccgaaccctgtggaaaagaatattaagaacgctaaatataagctggaccagctggtcagcttccgcgttccctactatgtgggacctatgatcaccctcgccgatcagcagaaaacatccaaggcctcttttgcttgggccgtgcggaaaaaggctggcaaaatcaccccctggaatttctacgacatgattgacagagaaaagagcgccaacaattttatcaagcgcatgaccaacaaagatacatatctgctttccgaagacgtcctgcccgcgagctctctcctgtaccaaaagttcacggtgctgaatgagcttaacaatattcgggttaacgggagaaaactccagcctgccctgaagcaggctatctataccgatctgtttcaaaaacgcaagacagtgaatctcaagaccctgacaaacttccttgccattcacgagccgaccctgacgaaacccaagatcgaaggactctccaacggccggagctttaattctagcctggggacatacattgacatgtccaaaatcctgggagattctcttgacgatctcaactacagagacgatatcgagaagattatcgaatggagcaccgtcttcgaggactccgagatttatggcgtgaaactgcaggaaatccagtggctgaccaatgagcagcgggaaaagctcgttcgcaagagataccaaggctgggggcggctgagcaaaaagctgcttacaggaattaccgatgagaacggccagagaatcatcgacctcatgtgggatacatctaaaaattttatgcagattgtgcatcagcctgtcttcgaggagcaaatcgctgagctgaaccagcagctgcttcaagacgccgacaaggcgcccctcgaagtggtcgatgacattctggccgatgcttatacgtcccctcagaataaaaaggccatccgccaggtggttaaggtggtcgctgacgtggttaaagccgtggggaacgcccccgctagcatttctatcgagttcgcgcggaatgaagatagaaacaaggagctgaaaaattcccgcagacacagcatcgaaaagctctaccacgagaccgccgagaaactggtcaagcagacaaaccttctggaggagctcggaaatgtgaaagacctgaacgatcggtattacctgtattttacccaagctggccgcgacatgtacgatgggacaccgattaatatcgacgaaatttccacccattacgagatcgatcacattcttcctcagtctttcctgaaggacaacagcctcgacaacagagtgctggttaagaaatccgaaaatgccgccaagtctgatcgggtccccgctaaactctatggcgccaagatgcgcgcgttttggaaacagctgaaggagagccagcttatctccaacagaaagtacctgaatctcacgaccgaccctgagcaagtggataaatatcagatgcagggattcgtgcatcggcagctggtcgaaacacgccaaatcattaagctggctgccaacatctttggcagcctttaccccgactctgccgtgattgagaccagagctgaactgacaaaacagctccgggagaagttctccctgtataaagttcgcgatgtgaatgactaccaccatgccgtcgatgcgtatctcaccgcttttgccgggcactacctgtaccagagatatcctaaacttcggcccatgttcgtgtacggagactatgccaagatctacgctgatgacctgaaaagactccgcagcgttaacctgtttcacgatctggagaaggaccagtataattctggcacggccgtgaacccggaaacaaaagagaagattgtcgatgtggactggctttccgactacgttagcaaaatccaacatttcaagtatatgctgatttctaaggctgtgtacacccagcacgggcagctctacggagccacaatcctgcctgtcgcgcaagtggataaaatcagcgcccccattggcatcaaggacgataaacccgtggacatttatggggcttacaccaatgaagtcgccgcttatatggccatcgttcgggtgaacggcaagaaacctaagtacaaggtggtctccgtgccggttagaatgctccagcgcctgaaaatggccgagcagaagggacatgatcagtatatgcaaacccttcacgacgtgctgctgcggaattttacaagcctcaaaaagaacagaaaaacgggcctgaaggaagctgtcgtgaaagatttcgacgttcttgtgccctgtgtccgctacaatcagctggtgattgatggggacaccaagtttacactcggatctgcgacctatcagcacaacgccaagcagctggttctctgcaatcattccctggagacacttgctaacaacttcgagtacgtgcggaaacaccctgatgaagccgacgagagaatgatcatgctgtacgatgacatcctggaccaagtcaatcattatttcaccctctacgataagaacaaatttcgcgaaaagctgaatgccggccgggacaaatatcttaagctgcccacgttcagccagtttgagaacaataagaaaacagctattgggaagtccgaagccatcattaacatcctcagaggactgcacgcgaatgctgccattaccaacctcaaatgtctgggcgtgtctacccctttcgggcagcttcagagcccctccggcatcgagctgtctgagaatgccaagctggtgtaccaaagccctacaggactcttttcccgggaagtcctgcttaaagatctgtga

SEQ ID NO: 4436 - RNA, 4191 nt, synthetic construct
  misc_feature 1..4191: note = Cas9 variant
  source 1..4191: mol_type = other RNA
atggccaacctgagaaattacaagggcgactataacatcgggctcgatatgggaaccggcagcgtggggtgggctgtcacagactccgagggaaaactgcttcacttcaagaaacagcccacgtggggctctcggctgtttgatagcgccgaaaccgcggcttccgcccgcattcctagagggcaacggcgcagatacgttcggcgcagatggcggctcgacctgcttcagcagctgttccaggatgaggtgtctaaggccgacccggaatttttcatccgcctcagacaaagccggctgctgaaagaggatcgcgaagagggacatagagactataatcaccccctctttaacgattccgacttcacagagaccgattactataatcggtttcctacaatttaccatctgcgcaagtggcttatggaaaccgacgagaaggctgatatcagactggtgtatctcgccgctcacaacattgtcaaacatcggggcaatttcctgagacaggaaaacacatctcttagcgccaagaatgcgcgccccctggacgccctccgggagtttagatccgctctggtggactggtgcgccgagctgggctacgaatgtaaccctgatgagagcggggaaatctctaatgagatcctctccgttctggaagaggagcacgtggctaacagcgacaaaaagaaacgcatttcttcccttatcggagtcgccatgaatgaaggcgcgaaggagagcaaggcctgcaacgatgctctggccggggctatggtgggactcaaagccgaatttaagaatgtttttggcgagatttctgccgaacagacctccatctacctgagcaacgacgaggctgtggatgcgcttcgggaggggattcccgacgaaggactggaactcttcggcaaactgtgttccgtctattctgcctacgtgctgcagggcctcctgagctatgctcctgggcaaacgatctccgtgaacatggtcgccaagtacgaaaaatatggaaatgatcttaagaccctgaaagccctcgtttgcgagtacgctagagccgaatatgacagctttttccgcggcgagttctaccgggatcaggacgggcacgagctgaacatttacaatgcgtctaaggctcagggatatacaagatacaaccttggcacctccaagatgagctatgaagattttgagaaagccgtgaagaaactgttcgccgggacagctgccgaagaggacggacgctacctccagatgatgaaggagtttggcgaacaacggttcctgagacgcctgaaaacctctgacaatggcagcatctattaccagctccatctggaggaacttacggctatcctgtccaaccaggggaagcactatccgtttctcgtggaggatgccgaaaagattaaatctctggtcagcttccggatcccctactacgtgggacctctgacagacagaaatgcgcggaaggataaacatggcaagaaccgctttgcctggtccgagagaaaaagcgggatggaggacgctgttattaccccctggaattgggatgaagtgatcgaccggggaaagtctgccgaggctttcattacaagaatgaccggcatgtgtacctatcttcaaggggaagatgtcctccctaagtgctccctgctgtacgaggaattttgtgtgctcaacgagctgaatggcagccgctggggaatggacggcgataaagagcaccggttcgacgccgcggatagagaagccatcatcgaggaactttttaagaaaaagaaaacagttaagtataaggacgtggctaactggctggagcgcgaagccgggagaatgaatgtccacgtgatgggaggccagggggagacgggatacgagtctaaactctccagctattacttctttcggcgcgatattttcgacgtcgaggagctggacagagctgattatcccatgatcgaacagattatcctgtggaacacccttttcgaggaccggcgcattctcaaggagaaactggaagatgcctacggcccgaaggggaatggcagactggacgatgaccagatcaaaaagatctgccggaaacgctttacaggatggggcagactctccaagaagttcctgaccgggattaaagtggatacagactgtggacctcggtctatcatggatgttcttcgcgagggcgaccccaacgccgggtttagaggaaagaccatggtgatgatggaagtcctgcgggatgagaacctcggcttccaacagaaagtggacgaatttaataagaactacttcgggcagaaaggcaaggctctggaggttaatgagctgcctggaagccccgcgattagacgctcccttaaccaggccatccggattgtggatgaaatcgctaagattgccggcaaagaccccgagtctatctttatcgaagtcacgagagacgatgagctcgacaagcgcgggaaacggacaaagagacgctatgatgccctgaaagaagctctgaccgtgttcaagaaggaggaccctgagatttgggccgaactccaagcgaccagcccgtccgatctggacgagcggcttacactgtactttatgcagagaggaaaatgcctctatagcggcgaacccatcgatattaataagctgtcttccggggagtacgaagtggaccatatcattcctcgcagctatatcaaagatgactctctggagaacaaggctcttgtttgtcggaaatacaatcagtccaagaccgatgccatgctcctggaccccagcatcagacggaagatgcgctcttattgggacatgctgctcgatgccaaactgattggacctaagaaacacagaaaccttctgcgggaccatatcgatgagaaggctatgaaaggcttcgtcgcccgccagctcgtggaaacaagccaatccgtgaagctggcggggagcctgctttctgtcagataccccaatgctaacattgtgccggttaaagcctccatgagccacgacctgcgggaggccgctggctttgtgaagtgcagagaagccaatgatttccatcacgctcacgacgcctacctcgcgtgccgcatgggactgtttatccagatgcggcatcctaaggtctatgagaaccccattgccatgacgagagtgatgcagaaatacgctcagcaacagtccaaggagttcaatcgcaaccaccgggttcctggcacctctgggttcatcgtgaatagctttatgtcctctggattcgataaagaaacaggcgagatctttaaggacacctggaacgccgaaacagagattgaagggatcagaaaagctctcaactatcgccagtgttacattagccggatgcccatggaggataccggagccttctggaatgccacggtctattcccctagagaccccaagatgggcccgaagctggcgcttcctctgaaaaagggcctcgatcccaaaaagtacgggggattttctagccaacagttcgcttatttcttcgtgtacgaggcccgcgacaaaaaggataagcaggtttttagattcgctgaagtgcccgtctggctggcctcccagatcgagagcgacaaaattgccctggaacggtacgctaccggccttgccgaggcggaaaagctgaaatttgtgcgcatcgagagagctaagatcctcaaaaagcaactgattgagatcgacggggatcggttcattctcacaggaaagaaagaaatgcgcaacggcagagagctggccctttctcagaaggaaaccctgaatctcatcgtggccggggacgagaacgcttccctggatgaccggggaaatgccagcgatgcggtcttcgacgctattgttagacagggcgatgaaatcggcctgcgcctttataaacagctgaagattgccgagatcgccgagcggtacagatctgtgggggctgacgccaaagtgggagctgtcatgtccctcctgagctctatcaacgcctccagcaatatggtgaacctctccatggttggcgggagcaagtatgcgggaaatctgcaacctaactactctaatcttctgagcgatccggaaacaaactttgtgattatcgaccagtccgtcaccggcatgttcgagcgccggacgagaattgggctgtga

SEQ ID NO: 4437 - RNA, 4191 nt, synthetic construct
  misc_feature 1..4191: note = Cas9 variant
  source 1..4191: mol_type = other RNA
atgaccaagccctacagcatcggcctggacattgggacaaactccgtgggatgggccgtcatcacggatgactataaagttcctgctaagaaaatgaaggtgctcggcaataccaacagagattacattaaaaagaatctgcttggggccctcctgttcgacggaggcgagacagcggaagggcggcgcctgaagagaaccgctcggcgcagatatacacggcgcaaaaacagacttcggtacctgcaggagatctttgccgaagagatgatgcaagtggatgaatctttctttcagcgcctcgacgatagcttcctggtcgaggaggacaagcagggatccaaatatccgatttttggcaccctgaaggaagagaaagaataccacaagaagttcaaaacaatctatcatctcagagaggagctggccaattctaaggaaaaagctgatcttcggctggtgtacctcgccctggctcacatgatcaagtttcgcggccatttcctttacgagggggacctgaaagccgaaaacaccgatgttcaggcgctctttaaggacttcgtggaggaatatgataaaacgattgaggagagccacctgtccgaaatcaccgtcgacgccctgtctattctcacagagaaggtgagcaagtccagcagactggaaaatcttatcgctcattaccccaccgagaaaaagaacacactgtttggaaatctcattgccctgtctcttggcctgcaagctaacttcaaaaccaattttcagctctccgaagacgccaagctgcagttcagcaaagatacgtatgaggaggacctggaagggctcctgggagaggttggcgatgaatacgcggaccttttcgtgtctgccaagaacctgtatgatgctatcctcctgtccgggattcttacagtcgacgataatagcaccaaggcccctctgtctgcttccatggtgaaacggtacaaggagcacaaagaagaactcgccgcctttaagcgcttcatcaaagagaagctgcccaagaaatatgaagagatctttaaggacgatacaaagaacggatacgctggctacgtgggcgcggacaagaaactgagaaagcggagcgggaagctcgccaccgaagaggagttctataaatacgtcaagggcattctgaataaagttgaaggagctgattattttcttgacaagatcgacagagaggatttcctgcgcaaacagcggacctttgacaacgggtccattcctcaccaaatccatctccaggaaatgcacgccattctgagacgccagggagagcattaccccttcctgaaggaaaaccaggataaaatcgagaagatccttacatttcggattccttattacgtgggcccgctcgccagaaaggggtctcgcttcgcttgggccgagtataaagcggacgaaaagatcacgccctggaattttgatgacattctggataaagaaaagagcgctgaaaaattcatcacccggatgacactgaacgacctctacctgcctgaggaaaaggtgcttcccaagcactcccctctgtacgagacctttacagtctataatgagctcaccaaagtgaagtacgttaacgaacaaggagaggccaaattcttcgatacgaatatgaagcaggaaatttttgaccacgtgttcaaagagaacagaaaggtcacaaaggataaactgctgaattatcttaacaaggaatttgaggagttccgcatcgtgaatctcaccggcctggacaaagaaaacaaggcctttaatgctagcctgggcacctaccatgatctccggaaaatcctggacaagtctttccttgacgataaggttaacgagaaaattatcgaagacattatccagacactgaccctctttgaggatagagagatgattcgccaacggctgcagaagtattccgacatcttcacaacgcagcagctgaaagaacttgagagacggcactacaccgggtggggacgcctcagctataagctgattaatggcatcagaaacaaagaaaataagaaaacaatcctggattacctcattgacgatgggtacgccaaccggaactttatgcaactgatcaatgacgatgctctttctttcaaggaggaaattgccagagcgcagatcattggagacgtggatgacatcgccaacgtcgtgcatgatctgcccggcagcccggctatcaagaaagggattctccagtccgtcaagatcgtggacgagctggttaaagtgatgggccacaatcctaccaacattatcattgagatggcccgcgaaaatcagacaaccgacaagggacggagaaactctcaacagcgcctgaaacttctccaggatagcctgaagaatctggacaaccccgtcaatatcaagaacgtggagaatcagcaactccagaacgatagactgtttctttattacatccagaatggcaaagacatgtatacgggggaaaccctggatattaacaatctctcccagtacgacatcgatcatattatccctcaggctttcattaaggacaacagcctggataaccgggttctgacacgctctgacaaaaatagaggaaagtccgatgacgtgcccagcatcgaggtcgtgcacgaaatgaaatctttttggtccaaacttctgagcgtgaagctcatcacccaacggaaattcgacaacctgacaaaggccgagcgcggcgggctcaccgagaatgataaagcgggattcattaagagacagctggttgaaacgcggcaaatcacaaaacacgtcgcccaggtgcttgacgctcgctttaacgccaagcatgatgagaataagaaagtgattagagacgtcaagatcattaccctgaaatccaacctcgtgtctcagttccggaaggattttaaattctataaggttcgcgaaatcaatgactaccaccatgctcacgatgcctatctgaacgccgtgattggcacagctctgcttaagaaataccccaagctggcgagcgagtttgtctacggggagttcaaaaagtatgacgtgagaaaatttatcgccaagtccgataaagagatcggcaaggctaccgccaagtacttcttttattctaatctcatgaacttctttaaaaaggaggttaaattcgccgacggaaccgtggtcgaacggcctgatattgagacaagcgaagacggcgagatcgcttggaataagcagacggatttcaaaattgtgagaaaggttctgtcctacccgcaagtgaacatcgtcaagaaaaccgaggtgcagacacacgggctcgaccgcggaaagccccggggcctgtttaatgccaaccctagccccaaacctaagcccgactcttccgaaaatcttgtggggattaaaagaaacctggatccgaagaagtatggaggctacgcggggatcagcaactcttatgctgtcctcgttaaagccatcattgagaagggcgtgaaaaagaaagaaaccatggtgctggagttccagggaatctccattctggaccgcatcacatttgaaaaggataagcgggccttccttctgggcaaagggtacaaggacattaaaaagatcatcgagctccctaaatacagcctgtttgagctcaaggatggatctagacgcatgctggctagcattctttccaccaataacaaacggggcgaaatccataaggggaatgagctgttcgtcccccagaagtttacgacactgctctatcacgccaaaagaattaacaatcctatcaacaaggaccatattgaatacgtgaaaaagcaccgcgatgacttcaaagagctgcttaattatgttctggaatttaacgagaagtacgtgggagcgaccaagaatggcgagcggctcaaagaagctgtcgccgatttcgacagcaagtctaacgaggaaatctgcacctcctttctgggggccgtgaatagcaaaaacgctggcctcttcgagctgacatcccttggatctgccagcgattttgagttcctgggcgttaagattcccagatatcgggactacaccccttcctctctgctcaaagatagcatcctgatccatcaatccattacagggctttatgagacgcgcatcgacctgtctaagctcggagaggactga

SEQ ID NO: 4438 - RNA, 4191 nt, synthetic construct
  misc_feature 1..4191: note = Cas9 variant
  source 1..4191: mol_type = other RNA
atgaagagagtgaacgaggactacatcctgggcctcgatattgggaccaatagctgcggatgggccgtcacagacaaaaagaacaatctgcttaaactgcggggcaagacggctatcgggtcccacctcttcgaagagggacataccgccgcggatcgcagaggctttcggacaacccgcagacggctgaaacgcagaaagtggcggcttcgcctgctcgaagagattttcgctgaacccatggccaaggttgaccctgggtttttcgtgagactgcaccagtcttgggtgagcccgctggataaagaccggaagaaatataacgccatcgtctttcccacagctaaggaggatcaagccttctacaaacattatgctaccatttaccacctccgcgacgagctgatgacacaggatagacagtttgaccttcgggaaatcttcctggccatccatcacattgtgaagtatcgcggaaattttctccaggatacccctgttaaggacttcgaggcgtccaaaatcgaagtgggccccattctgtctcacatcaacaatgcctttgctgagaagattgtcgaggatcaagaccctatcgaacttaacgtggccaatgctgccgacattgaggatgttatcagaggcaaagacgcggaaaagacggtgtacaaactggataaggtcaaaaagatcgccaagctcctgaccgacagcacagctaaagaggaaaagaacgtggccaaacagattgctaatgccatcatggggtataagacccagttcgagacaattctggataaagagatcgacaagtccgataaggcccagtgggaatttaaactctctgacgctgatgcggacgataagctggacgcccttctgcccgacctcgatgagaccgaccaaacggtggtcgctgaaattgagaaactgttcagcgccatcacactttccaccatcgttgatgaaaacaagagcctgtctcagtccatggtggagaaatacaagaagcataaaaaggactacaaaaagctcaaaaagtatattaatacactgcaggatcagaccaaggccaaaaagctgctcctggcttacgacctttatgtgaacaatcggcacggaagactgctcgaggccaaaaagaccttcgaagataaaaagaaaaagaaggcgctgacaaaagacgagttttacaagatcgtcaaagataaccttgacgatagcgacctggctcatgaaattcaacaggagatcgccgccgataacttcatgcctaagcagcgcacgaatagcaacggcgtgattccgtttcaactccaccagatcgaactggacaaaatcattgctaatcaggggaagtattaccccttcctggccgctgagaaccctgttgaggaccaccggaagcaggccccctataaactcgatgaactggtgagatttcgcgtcccttactacgtgggacccatgatcaccgcggacgagcaagaaaagacatccggcaaatctttcgcctggatggttcggaaggaggatgggcagattaccccgtggaattttgagcagaaagtggacagacaggaatctgctaacaagttcatcaagcgcatgacaattaaagatacctatcttctgtccgaggacgtcctccctgccaatagcctgctgtaccaacggtttgaagtgcttaacgagctcaataacatcagaattaatggatcccgcatctctgtcgatctgaagcagcagatcttcaacgacctgtttgaagagaaaaagacggtgacagagaaaagcctcacctcctatctgaagcagaatcttcatctgcccaccgttgaaattaagggcctcgctgatcctacaaaattcaacagctctctggcctcctactatcaccttaagagcctgcatgtgtttgacaaagagctcgcggatccccaataccagaaggacttcgaaaagatcattgagtattctagcatcttcgaagataagaaaatttttcaggacaagctgcacgccgagttcaagtggctgacccccgagcagtttaaagctatctccacatggcggctccaaggctgggggagactgtctcgcaaacttctggtcgaactccatgacacgaatggacagaacatcatggagcagctgtgggatagccagaaaaacttcatgcaaattgtgaccgaacctgactttaaggatgccatcgctaaagagaatcagaacgttacacgggccaatggcgtggaagagattctggccgacgcttacacctccccggcgaacaagaaggccatcagacaggtcgtgaaagtggttgctgatgtcgtgaaggccgccgggggcaaaaagcccgctcaattcgccattgagtttacacgggaccctgataaaaatccccagcttagccacatccgcggaaccaagctcctgaaggcgtaccaggaaacggctggggagctggtggaccagaaactcaccgattctctgaaggaagccatgacatccagaaaacttctgaaggacaaatatttcctctactttatgcaagccggacgggatgcttataccggccagaagatcaacattgacgaggtcagcacaaattaccagatcgaccacattctgcctcagtctttcatcaaggatgactcctttgataacagagtgctgaccgccacgccccttaatgcggagaaaagcgacgatgttccgtataagcgcttcgctaacaattacgtgtccgacatgaaaatgacagtcggcgaaatgtggaagcattggcaaaaagccgggattatcaacaagcacaagctcggaaatctgctgctcgatcctgaccggctgaacaaatttcagaagtctggcttcatcaatagacagcttgtggagaccagccaaattatcaaactggtttccgtgattctccagaacaagtatcccgatgccgaaatcattacagtcaaagctggggacaactctgccctgcgccagagactgaatctttacaagagccgggatgtgaacgactaccatcacgctatcgatgcctatctgtccattatctgtggaaatttcctctaccaggtttatcctaaataccgcccctattttgtgtacggcaagtataagaaattcagccaagaccctgacctgcagaaggaggtcatcaaacactttaaggggttcacctttatgtggcccctcctgcagaaagataactctgaaagaaaggcgccggagaagattaaagagaataactccgaccggatcgtgttctacaagcatcctgatatttttgacaaacttcgcaaggcctacaattataaatacatgctggtgagcagagaaaccacaacggagaactctggcctcttcgatgtcaccatctatccccggggagaacgcgacctggctaagacaagaaagctgattcccaaatccaatggccttgatcctaagatctacgggggatatagcggcaacaccgacgcctacatggttatcgtgaaaattgataaggggaaagagtctatctataaggtgattggagtcccgatgcgggctctggccagcctcaatcgcgccaagaaacagggcaactacaaggaggaactgcaccaagtgctcgagccccagatcatgtttgacaaaaatgggaagcctaaaagatccgttaagggcttccggattatcaaagatcatgtgccctttaagcaggtcgtgctggacggagataagaaattcatgcttaacagctctacatacgaaatcaatgctaagcagctgaccctcacgcctgagacaatgagaattgttaccgacaacctgaaaaagggcgaagaccaagatcagctgcttgtgaaagcgtatgacgagatcctgcagaaggtcgatcagtacctccccctgttcgacgtgaacaagtttcgcaattccctccacctggggcgggccaaattccttgatctggctgttaacgacaagaaaattaccctgacaaatatcctcaacggactgcatgataatcttgtgacccctgacctgaagaacattggcatcaaaacacccctcgggaagctgcaagtcccgagcggaattgtgctctcctctgaagccatcctgatctttcagagccctacgggccttttcgagaagagagtgcgcattgccgatctgtga

SEQ ID NO: 4439 - RNA, 4194 nt, synthetic construct
  misc_feature 1..4194: note = Cas9 variant
  source 1..4194: mol_type = other RNA
atgaaggactacaacatcggcctggatattgggaccagctccatcggattcgccgctattgacgatgacaataacctcatcagagtgaaaggcaagaatgtcattgggtctcggctgtttgccgagggaaaaacagcggctgaacgcagaggcttccggacggcccgcagacggtataaccgcagaaagtggcggcttaaactgctcgatgagatcttttacgaagagatcattcacatcgaccccgagttctttaatcgcctgaagcagagctccatttctcctaaggatgagagcaaaaagtatttcgggtcccttctgtttccggacaaaaccgattctgcctactatcatgacggaaaccaaacaatctaccacctcagaaatcggctggttcatcagaaggagaaagctgatattcgcgaaatctatctggccctcagacacattgtgaagtaccggggcaacttcctggacagcacccccgtgtccagctttgaggctgataatcttaagctggacgaactcgtccctgtgatcaacgacatgtacgagaatatcgatattgacttctctatcaacgttgataatatttccgagatcgaaaaagtgctgcttgacaaccatctcaagagcgccgataaacaggaccgcctgaaggagctgctgtatgataatcccgaataccctgacgataaagtcaagcagaaagagatttctaagtttagaaaggacctcgataaagaaatcatcaaggtgattgttggctataaattcaacgcgtacaagatcgtgaactatattcccgacgacgggtccaaatttagcttctctttctccgatgagagctccgacgataagctggacgatctttctgaggtcctggacgatagccaaatggaaatcctcaatacactgaaggtgatttactcccgggtgagacttaaccagatcatccctaatggaatgggcctgagcgagtctatggtcgccaaatataaccgccaccacgaacagctcgaggacctgaaggaactgctcgatgttctgccgaatgacgagaaacggtccattgagtacgcttacaccgcctatatcgggaacgtggataagcagaaatacaataacaatcttgtggctagcctgaaggacctccccattaagggagatatcaacaaaaagattcaagccgtctttgaatatgcgaaaggccatatctctagccaggacctgtacgacgtgattaagacaatcatcattgataaatatcttgaggacgaatccttcgagtaccacgatctggttgaaagaatctctaatgacattgataacaaggactatctcctgaagcagcgcagctcccagaatgggaacatccctcatcaagtgcaccagatggagatggataaaattatcgccaatcagagccaatactacccctttctgggagtcctcaaccctaacgagtctcggagacacatcgctaagtataaaatttccgaactggtgagcttccgcgttccctactatgtgggcccgcttatcacccctgaggaacaggagaagacgtctggcaaacattttgcctggatgaagcggaaagaggctgggaagattaccccctggaatttcgaagagaaggtcgacaaagaagccacagccgctaagtttatcaaaagactgaccgtgaaggatacatacctcctgaacgaggacgtcctgcctgataattcccttctctatcagcagttcaaagtgctgaacgaactgaatattgttaaggtgaacaataagcgcctcaccctgagcgagaaacaaggagtctacaacgacctttttaagaatacgaaatccatcacagtgaagcggctgaaaaactatctcatctctaattacaagcacctggagaacattgaaatcaccggcctgagcgatggggacaagttcaataactcccttggaacatacaatgactttaaaaagattttcggcgcgagaatcgatgacgttaactattctgccgattttgagaacattatcgaatggagcaccgtgttcgaggaccgctccatcctcaaagaaaagctggagaaagatattgactggatcacccccgaggaaattaaggctgtcgtggccaagcggtacagcgggtggggaagactgtctgccaaactcctgacagagcttctggatgacgatggccagcggatcattgacatcctctggaatgattccattacgttcatggaagctgtgagcaagcccgagatcaaagcccagatccagaacattaatcgcgactttatcaaggcgaccgacattgaaacagttctggatgaggcttatacctctcctcaaaacaaaaaggccatcagagaggtctacaaactggtgaaggacattcagaaggccatgggcgggaaagctccgtccagcatctctatcgaatttacacggagccccgaggataatggatccgtgaccaagacgagatataacaatatgcagaacaaatacaaggaacttggcaaagagctcagcgacgatctgtctgcccagctgaaggagtataaggggcgcatggaccaagataaattttacctctacttcatgcagatgggaaaggacctgtatgatggctccacaattaatcttgacgatctgaacagctaccagatcgaccatattgtccctcagtccttttataaagatgactctatcgacaatcgggtgctcacccactacaccaacaatcaaaagaaagggaaccatacacccctgaatggcctgaacattgatgctcagacccagaacctttggaagcacctcaataagctgggactgatcagcaaaaagaaactccaaaacctgtgcttcaaggacatcaatcagctttccaaatatacaaagcacggctttgttagacgccagctggtggaaacgtctcaggtcattaagctcgtggccaacatcctgagcgatgagttcgcgaatgacgggaccaaaattatcgaagttaaggccaaaatgaactccctgatgagagatacatttaatctttacaaggtgcggcaactgaacgactatcatcacgctgtcgatgcctacctcaccacattcgtgggaaaatacctgtataagcgctaccctaagctcagatctatgtttgtttatggcgacttcaaaaagtttagcgctgaggatgacctgaaagatattaagaccttcaatttccttcatgacatcacgaaccccaaagaatccaataaggagaaaatttacgatgaaaagagcggggaactgatcctcgaccggaagcacgccatcgagaccattaaaaagatctatcagtacaaatttatgctgattgtgcgcgaagtctctacaaagtccggacagctgttcaaacagaccatctatagcgcgaagaagacaaacggccttaaatctgccattccggtgaagtccaatctggagcctagcatctacgggtacagatctggcaacgtggaccaccatatggtcatcgttaaaattaagaaaggaaccaagtattcctttaaggtgatcggcattagcgctcgggccatccaagaactcgagattgctaaaaagatcgggaattaccgcgataaactgtatgaggtggtctccgacagactcagccagtctatgaaaagcgtggaatccttccggatcattctggataacatcatgtacggacagcttattgttgacggcaatgataagtttacgctggggtctgccgactatcgcaagaacagcagacagctcgtgctgtgtacaaactccctgaagatccttaaagatgaggactacatgaatcggctgtctgatattcaaagaagcaagctcatggtccaggtgtatgacgaaatcattaaaatcatgaagaacaaatactccctgttcatctctaataccgagaagctcctggaaaaacgcgatattttctgcggacttagcttcgacgagcagaagatcgttatttggaagatcattatcgacctgcacaacggcccctttacaaaaatccaagagctggggattaataacaagatgggcaccttccagaccaaacatggaatcattctcacagaaaatgccatcgtgatttaccagtcccctagcggcctgtttgagcggaaggtcagacttaaagatctgtga

SEQ ID NO: 4440 - RNA, 4194 nt, synthetic construct
  misc_feature 1..4194: note = Cas9 variant
  source 1..4194: mol_type = other RNA
atgaagaaagtgctgggcctcgacctggggaccaacagcatcggatgggcccttgtcaatgaggctacaaaggaagagaaaaaggaaggcaaatcctctgagattatcaagctgggggttagagtgaaccccctcacggtggatgaaaagaccaatttcgagaaaggacggcctctgagcacaaacgccgaccgcacccttaagagatccgcgcggcgcaatctgcagagatacaaactccggcgcagaaacctgattgagatcctgattaagaatggctttatcacaaaagataccccgctcacagaaaccgggaaggacacgacccaccaaacactgaaacttcgggctaaatctgccaaggagaaagtcgatctgaaggacttcgccaaaatcctcctgaccattaacaagaaacgcggatataagagctccagaaaggttaattctgatgaagacggccttgctatcgatggcatggccgtggctaaacatctgtacgagcagaacctcacacccgggcagtatgtgctgaatctgctccagaagaacaaaaagtacgtccctgacttttatcggagcgatctgcaagaggaatttaaaaatatttggaacaatcagaagacctactattttgacatccttacggatacactgttcgaggaactcaaggacaaaaacaagtcccagacctgggccatttgcaaaaagccctttgacatcgcgggaattaaacagatcggcaaggccagcgataagcgcctggagagatacaaatggcggacagaagggcttacccaaaagctgaacctcgagtacctggctatcgccctgcaggagattaataacgacatcaataaatcttccggatatctcggcgctattagcgatcgctctaaggaactgttctttaacaaagagaccgtgggggaaaatctttacagacagctggttaagacacctcacacgtccctccggaaccaggtgttctatagacaagactacctggatgagtttgaaaccatctgggagacacaggccaagttctatccccagcttacccatacactgaaagaggaaattcgcgacgtcatcatcttttaccaacggaagctcaaaagccagaagtctctgatttccttctgtcagttcgagagctgggaacagacctatatcgagaaagaaacgggaaagtccaaaacaagaaccgtgggccgcaaggtgattcctaagtctagcccgctgtttcaagagttcaaaatctggcagaatctcaactccctggagtttcggaatagcgatgaaggcgagattatcgagttcatcaaacttgacgaggatattagacagaccgtctttgaggaactgaacctccgcgggaatctgaaacccaacgacgttctgaagatccttggaaattacatttctctcggcaaagtgtcccagtggaagtgcaacttcgaggaaatcgaggggaatcggacaaacgcggccctgtacaacgtgtatcaaattatcgctgaaaatgagggatacggctttgattgggccaagaaaaccgctagcgagattaacaaggaactgaaaaatatcttccctcagctcgggatcgacgcctctattctggactttgatttcacacaggccaactttgacaagcagacgagctatcaactttggcatctgctctactccgctgaggaagatttcaaaatctctgaggaagacaaggtcctgtatggaaatagctccgtgagcctgaagaaaaagctccaccagaaatacggctttaagcccgagtataccaaacttctgacaaacatttctctgcagcctgattacggcaatctctccgcgaaggccatctgtaacattctgccctaccttaaggagaataacgtttatagcgaggcttgcgacctgaccgggtacaatcactctaacttcctcacagccgaagaacaggccaaaagaccgctgaagcctatcctggagcttctcaaaaagaactccctgcgcaatcccgtggtcgaaaagatcctgaatcaaatggtgaacgttgtgaaccaggtcattgagacctatggaaagcctgatgagatccggattgaactcacgagagagctgaaaaagagcgctaaggaacgcgccaatatgaccaaatccatcgcggacgctacacggagaaacgatgactaccggaagaccattatcaaagagttcggcatccccaatcccacaaagtctgatgtggtccgctatagactttggcaggagctggccagccgggggtacaaagacatttttaccgatacggaaatcaagcctcaagaactcttctccaacaagattgacatcgaacacattatcccgaaagccctgctgtttgacgattctttcagcaataagacacttgcttttaaaaaggacaacctcaaaaaggccaatagaaccgcttatgatttcatcgccaacgactacgcgcccaatctggagaactacattgaacgcgtggagtccctgcataaggatcggaaaatcacaagagccaagcgcaataaactcctgatgcttcagagcaagctgcctgacggatttattgagagagatctccggaactctcagtatatcaccaaagaagctaagaagatgctgtacgaggtttgtcgcaccgtggtctccacaagcggctctattacggacaaactgagagaagattgggaccttatcaatgtgatgaaggagctgaacttccccaaatataaggccctcgggctgaccgaaaagattgagcggtacgatatcggcgctgagaagatgaaggaagttgagatcattgaagactggaataaacgcaacgatcacagacatcacgccatcgacgcgctcacagtggccttttccacccacagccatattcagtatctgaaccaccttaatgctcggcgcgacgagggacataagaaacacgccgctatcattgccatcgaatctacaatcaccgagaaggagggcaacaaaaagagacggttcattgcccctctgcccaattttcgcctccaagctaaagaacatatcgagagcattctggtctccttcaagaacaagaataaagtggtgacgaacaatatcaacaagacaaaaagaattaagaaagataagtttaataccaaggttcagctgaccccgcgggggcagcttcacaaagaaacaatctacggaaagatcaaacagcctctggagaagcacattaaactcaacaagagcttcaccctggagcaagcgaagctcatcattgacaaaagacagcgcgaaaaggtcctgaatcatcttgagaaatatgcccacaactctgatatcgctttcaattccaagacactgaaaaagaaccccctcctgattagcgacgaacctctgaaggaggtgctttgctttgaagaggtgttcacgatccggaaagatatttcctacgacaattttaagaacgagaaacagctggataaggtcatcgacgaaaaagtgaagcaggccctcaaagagagaatcaatcaatacaacggcgatttccgcgaagccttttctgacattgagcggaaccccatctggctgaataaggctaaggggatttgtgttaaaagagccaccatcaagggagtgagcaacgcggaacctctccatacagctaaaaatcacctgggcgaggaggtccttaccgaaaacaaggagcagattcccgtggattatgtttccacagggaataaccaccatgtggccatctacgaagacgaggacggcaatctgcaggaaaaagtcgtgtctttctatgaggccgttatccgcgtgaacgagggactgccgattatcgataaggaatacaataagagcctcggctggacctttaaattcacgatgaagcaaaacgagatgtttgtcttcccttccgaagactttaatcccaccgagattgatctgcttgaccagaaaaacgcttctctgatcagccccaatctcttccgggtgcagaagttcacaattaaagattatttcttcagacaccatctggagaccacagtggaaaacaataacaccctcaagaacacaacctggcgccgggaggggctgtccggaatctacggcatcattaagatcagacttaatcacctgggggaaattgtccaggttggagagtattga

SEQ ID NO: 4441 - RNA, 4194 nt, synthetic construct
  misc_feature 1..4194: note = Cas9 variant
  source 1..4194: mol_type = other RNA
atgaacgagaataaggaatggttcctgggcctcgacatcgggaccgccagcgtgggatgggctgccacagatacgaactacaatctgcttaaactgaagggcaaaaagtcctggggagtcagactctttgacgaggcgcagaccgctaaagaacggcgcgattgcagatctaagcggcgcagactggcccggcgcaagtggagacttgggctgctcgaggaactgttcgccgaggagattaacaaaatcgaccccaactttttcatgcggctgcgcgaaagcaagtataaagtttccgataagacaggcaatgtgccttctattctctttaatgagaaaaactacaccgacaaggaatattacagaaattataagacaatctaccatctgcgggctgatcttattcacaaaaacaatccggacatccgcgagctgttcctcgccatccaccatattctgaagtatagagggcactttcttttcgctggacaacagtttaaaggcagcgagatcaaggataacattcgggaactgctccagtacaattccctgaacatcaaaattgacatcaccgatgagctgattaataacatcgccgaaatcctcctgaagaaaaagaactctacagacaagattatcgagttcaaaaagctgtttgcggatgaaaaacagcttattgaggccctccgcctggctcttggcaataagacccaactggccaaactcttcgacatcgaggcttacaaggaactggacattagcatcaagacgatctcctttaaagagaagatttatgaagatgtgagaagcaactacgaggaaatcctgggggagtatattatcgtcctcgacaccgccaaactgatttacgatgcgatcatcctttctaagattaaaatcaagaatatgacaatttccgagagcaaggtggtttcttatgaaaaacatggaaaggacctgaaacagctcaagcacctgatcaaagaggattgtaaactttccaagaaggaaaagcggcagctgttcgagaacattttcgtgaaagaagacgagaagggcgccaattacgtcaactatatcgggaaaaataacgctggaagctctaagtccagctgctcctacgaggattttaaaaagttcctcaccaaggaactgaaatgttgcgaggaatctaagctgaaacaggacattctcgccgagctggagcttgaaacatttctgcccagacaacgcaccaaggataatagcgtgatcctctaccagatccacaaagaggaactggagaagattctgaacaatgctgttcagtatcatcctttccttaacaatacggacgaatacggcatctccattaaggagaaaatcattcagctcctggagtttcggatcccctattacgtggggcctctgaacacaagccacaaggtcggagatggcggcttctcttggtccgtgagaaataaagggtatgaacatatcgccgtgaccccctggaactttaacaaggtcattaataaagaggaaagcgccaagaacttcatcgagaatctcacaaaccaatgtacctacctgctttatgaagacgttctgcctaagcactctctcctgtacagcgagtttgctctgcttaatgagctcaactccattaattacggaggcaaacgcctgaccgtggaacaccggaacctgatcattgagagattctttaagcagtctgcgccgaaagccacagggaaggaactcaaaaagttcctgatgagcgagggagtgatcgacggcaaggatgaactttccgggtttgacgtcagcatcaaaaatgatctgaagtcttatcgcgacttcaaaaagattctcggagataaattcgactccgagaaggtggagaaaatgatccggtggattacgctgtttggcgaaagcaagcagctgcttgttgataagatcaccaaagagtacggcgacatttattctctcgaagagatcaagaaaatctccgggctgacatacaaggattggggaagactgagcgagaaactcctgaccgaaattgtgtcctctcaactttatgacgagagcacaggcgaatgcttcaacatcattaatgctatgcgcaacaataccctgctctttatggagctgctggggacgaactacgattatttcgaaaagatcaatatttacaaccggagacttcgcaaggagatcacagagattacaccccatatcctcgacgatctgtacgtctcccctgccgtgaaacggtctatctggcaggttgtgagaattgtcgaagaactgaagaaaatcattggaagcgaacccaagcggatctttgtggagaccacccgctccaacaaagaaaagaagggcgacgacgggagaaaagatagccggaagaaagccctcctggagctttataagaaaattaagacctctgacatcgtcgagctggaaaaggctctcggccacacagtggatttcgacaaaaagaaacaggatctgacggacatcgataataacaagctgaaagccagaaaactttacctgtattacacccagctcggacgctgtctgtatacaggcaaggcgattgacctcaataacctgctttccagcaattctgagtacgatgttgaccatatctatcctcaatccaagaccaaggatgggagctggaacaatctggtgctcgtcaacaaaacagaaaattctaagaaaagcaacggactgatttccgagagcatccagcggaagaataaacacttttggagattcctgaaggctaagaaccttatttctgaagagaaatacaagcgcctgaccagaacggaggactttaccgatgacgaactctccggcttcatcgcccggcagctgatcgagacaagccagtccgtgaaagccgtttctcaaattctccagaatctgaaccccaccacagaaatctgctttagcaaggctgagaatgtgcatgacttccgccaggagtttgggaaaattaaggtcggaaagagacggaaccttaccgaggagcagcaaaaagaagccaaggagggccagctgatcaaagtgcgcgatctcaacgacctgcaccacgctaaggatgcctacctgaatattgtggttgggaacgtctatcatatcaaattcacgagaaatccgaagaacttcattcggaaaaattccaagaaccgcgaatacacacttaataccctgttttattctgacaagatcgagagaaacggcgaggtggcgtgggaaaaaggaaagacagagaaaatcgtgagctccgtcatgtgtaataacctcattaatgtgacccggcgcacctctgaacagaagggcgccctgtacgatgctacaatctataaggccaacgctgccaaagaggggagctactatcctgttaagacgaaaaataagaacctcaaagacgtgaccagatacggaggcttcacatccattaagatcgcgtactatagcatttttaaatacgatatccggaataaggacaaggtcaaagaaaacatcaagattatccccattcctatctatatttctcagaatatcaaaaccgatctggaccttatcaacttcgccgagaagcaaattaaactgaagaagggggagaacatcgaaaatctgcagctcatttacaaaaagctgaacatcggagctcttgtgaaaattgattattacccctattacgttggcgggaagacaaatgacaacttttacatcgacggcgccgtgcaggtcctgctctccagcgatattgagagatatctgaaagaagtggttaagttcgtgaattttcaacgcgagaacaaggaagctaaagtctctaaggagcacatctccagcgaggaaaatatcgagctctacaacaccctgctttgcaaaatgacggccaagattttcacacataccaaaaataacaagtataatgacctggcccaggataaggctaaaaacacctttaagaatctgtctctcgaggaacagtgtaaagtgctgcttgagatcctgaacctcctgacaaataagaaaaccacattcgacctctccctgattaacgaaaaggcgagccgggtgaaatgcggatttaaccttctgaatcagaagcaattctccatcattgagcagagcgtcacgggcctgtacgaaaaggagatcaaaatcattgaagattga

SEQ ID NO: 4442 - RNA, 4197 nt, synthetic construct
  misc_feature 1..4197: note = Cas9 variant
  source 1..4197: mol_type = other RNA
atggagacccaggccagcaaccaactgatctcctctcacctcaagggctaccccattaaagactatttcgtggggctggatatcggaacaagctccgtcggctgggctgttacgaataaggcctacgaacttctgaaatttagatctcataagatgtgggggagccggcttttcgacgagggagaatccgcggtggctcgcagaggctttcggtctatgcgcagacggctggagcgcagaaaacttcggctgaagctcctggaagaactgttcgccgatgccatggctcaggtggaccctacctttttcatgcgcctcagagagagcaagtatcactacgaagataaaacaaccgggcattccagcaagcacattctgtttatcgacaaaaactataatgatcaggactacttcaaggagtatccgacagtctaccatcttcggtctgaactgatgaaatccggaaccgatgacattcgcaagctctttctggccgtgcaccacatccttaagtacagaggcaacttcctgtatgagggcgctacatttgatagcaatgcctctaccctcgacgatgttatcaaacaggcgctggagaacattacgttcaattgctttgactgtaactccgccatcagctctattgggcaaatcctgatggaagctggaaagaccaaatccgacaaggccaaagctattgagcatctcgtggatacatacatcgccaccgacacagtcgataccagctccaagacgcagaaagaccaggtgaaggaagataagaaacggctgaaggcgttcgccaatcttgttctgggcctcaacgcttctctgattgaccttttcgggagcgtggaggaactggaggaggatctcaaaaagctgcagatcacaggagacacctatgatgacaaacgcgatgaactggccaaggcttggtccgacgagatctacattatcgacgattgcaagagcgtctatgacgccattatcctcctgtctattaaagaacccggccttacaatctccgagagcaaggtgaaagcctttaataagcacaaagatgacctggctatcctcaagtctctgcttaagagcgatagatccatttacaacaccatgttcaaagtggacgaaaaggggctgcataattatgtccactacatcaaacaaggacggaccgaggagacatcttgtaacagagaagatttttacaagtatacgaaaaagattgttgagggcctcagcgactccaaggataaagaatacatcctgagccagattgagctgcagatcctcctgcctcttcagcgcatcaaggacaatggcgtgattccctatcaactgcacctcgaggagctgaaagcgatcctggccaagtgcgggcctaaattcccctttcttaacgaggtggctgatggattctctgtcgccgaaaagctcattaaaatgctggagtttcggatcccttactatgtgggcccgctgaacacccatcacaatgttgacaacgggggattcgcctgggctgtgagaaaggcctccggccgcgtcacaccctggaattttgatgacaagattgaccgggagaaaagcgcggctgccttcatcaagaacctcaccaataaatgtacatacctgcttggggaagatgtgctgcctaagtcttccctcctgtatagcgagtttatgctgcttaacgaactcaataacgttagaattgacggaaaacccctggagaaggtggtcaaggaacatctgatcgaggccgtgttcaaacaggatcacaagaaaatgaccaagaatcgcatcgaacagtttctcaaagacaacggctacatttccgagacgcataagcacgagatcacaggcctggatggggaaattaagaatgaccttgcttcttaccgggatatggtcagaatcctgggagacggcttcgatcgcagcatggccgaggaaattatcaccgacatcaccattttcggggagtccaaaaagatgctccgggaaacactgcgcaaaaagtttgcttcttgcctggatgacgaggccatcaaaaagctcaccaagctcagatatcgggattggggaagactgagccaaaaactgctcaacggcattgaggggtgtgacaaggcgggcgacggaacacctgaaacgatcattatcctgatgcggaatttctcctacaaccttatggagctgctcggcgataaatttagcttcatggaacgcatccaggagattaatgccaagctgaccgaagggcagatcgtgaacccccacgacattatcgatgacctggctctttctccggccgttaaaagagctgtgtggcaggccctccggattgtcgatgaggtggcgcatatcaagaaagccctgcctgctagaatctttgttgaggtgacacgctccaacaagaatgaaaagaaaaagaaagacagccggcaaaagagactgtctgatctctatgccgctattaaaaaggacgatgtcctgcttaacggactgaataacgagatcttcggcgaactcaagtccagcctggccaaatacgacgatgccgctctgcgctctaagaaactttatctgtactatacccagatggggagatgcgcgtacacaggagagattatcgagctcagcctgctcaataccgacaactacgacattgatcacatctatccccggtccctgacgaaggacgatagctttgacaatcttgtgctgtgtaaacgcaccgccaacgctcagaagtctgatgcctaccctatttccgaagagatccagaagacacaaaaacccttctggacctttctcaagcagcagggcctgatcagcgaaagaaaatatgagcggctgacacgcattacgccccttacggccgacgatctgtccgggttcatcgctagacagctcgtggaaacaaatcaatctgttaaggccgcgaccacactgctccggcgcctgtaccctggcgtcgacgtggtgtttgtcaaagctgagaacgtgaccgatttcagacatgacaataactttattaaggttcggagccttaatcaccaccatcacgccaaggatgcctatctgaacatcgtggtcggaaatgtgtaccatgagcgcttcaccagaaacttccgggcctttttcaaaaagaacggcgctaatagaacatataacctcgcgaaaatgtttaattacgacgttaactgcacgaatgctaaggatgggaaagcctgggacgtgaagacctccatggacacagtcaagaaaatgatggattctaacgacgtgcgcgttaccaagcggctgctggaacagacaggagcccttgctgatgccaccatttacaaagctacggtggccggcaaggcgaaagacggggcctatatcggaatgaagacaaaaagctccgtcttcgctgatgtgtctaagtacggcgggatgaccaagatcaaaaatgcctatagcattatcgtgcagtacaccggcaagaaaggagaggtcattaaggaaatcgttccgctgcccatttatctcacaaacagaaataccacagaccaggatctgatcaactacgtggcttccatcattcctcaagccaaagacatcagcattatctatggcaagctctgtattaatcagctggtgaaggtcaacgggttttactactatcttggaggcaaaaccaattctaagttctgcatcgataacgccattcaggtgatcgtttccaatgagtggatcccctacctgaaagtgctggaaaagtttaacaacatgcgcaaagacaataaggatctcaaggctaacgtcgtgagcacccgggcgctggacaataaacacacaattgaggttagaatcgtggaggaaaagaacattgagttctttgattatcttgtctctaaactgaagatgcctatctaccagaaaatgaaggggaataaggccgctgaactctccgagaaaggatatggcctgttcaagaaaatgagcctcgaggaacaatctattcatctgatcgagcttctgaacctgctcaccaatcagaagacaacctttgaagtgaaacccctggggatcacggcctcccgcagcaccgttggctccaagattagcaaccaggacgagttcaaagtgatcaatgaatctattacaggactttacagcaacgaggtcaccatcgtgtga

SEQ ID NO: 4443 - RNA, 4197 nt, synthetic construct
  misc_feature 1..4197: note = Cas9 variant
  source 1..4197: mol_type = other RNA
atggaaaagagctactccatcggcctggacattgggaccaactctgtgggatggagcgtcatcacagatgactataaagttcccgccaagaaaatgagagtgctcggcaatacggataagaaatacattaagaagaacctgcttggggctctgcttttcgactccggagaaaccgccgaggcgacacggctgaaacgcaccgctagacggcgctatacaagacggaagaatcgccttagatacctgcaggaaatctttgccaaagagatggccaaggtggatgaatctttctttcaacggctcgacgagagcttcctgaccgatgacgataaaacatttgactcccaccctattttcggcaacaaggctgaggaagatgcctatcatcagaagtttccgaccatctaccatctgcgcaaacacctcgctgactctcaggagaaggccgatctgagacttatctatctggcgctcgcccacatgattaaattccgggggcattttctgtacgacaatttcaacgacgataattttgactggcgcaacatcgatattcagaagagatacgaagagttcatcgagacgtatgacagcacccttggagaatcctacctggctgatattagcgtcgacgccgcttctatcctcgaggaaaaagtgtccaagacagagcggctggaaaatctgctcaaatattaccccaccgagaagaagacaacctttttcggcaacctgattaaacttatcctgggccaacaggccaagttcaaagcgatctttaatctcgaggatgaaattagcctgcagttcgccacgcctacatatgacgaggatcttgaggagctgctcgggaagatcgacaacggagattcttactccgaactgtttgttgctgcccagaatctgtataacaccattctcctggctagcttccttaaaacagacaataagtctgccaaggctcccctgtccaccagcatgatcgagcgctacgagaaccacaaaaaggacctcgccaaactgaaggattttgtgaaaaagaactgccctgaccaataccacgatattttcagagacaagtccaaaaatggctatgcggggtacatcgataacggagtctctcagaatgacttttataccttcatcggcaagtgtcttgaagagagcctgaaaaaggataaaggggcccagtactttctcgacaagattgatcgggacgatttcctgagaaagcagcgcacatttgacaacggagctttcccctatcaaatccatctgcaggaaatgcacgccattctccggagacagggcgattactatccttttctgaaagagaatcaagacaagatcgaaaagattcttacgttccgcatcccgtactacgtgggccccctggcccggaaggactccagattcgcttgggccaactatcgcagcgatgaggcgatcaccccttggaattttgacgaggttgtggataaagaaaagtctgctgagaaattcattacacggatgaccctcaacgacctgtacctgcccgaagagaaggtccttcctaagcattccctcatctatgagacatttaccgtgtacaatgaactgacgaacattaaatatgtgaatgatcaggggaacgccatccacttcgacagcgagctgaaggagaaaatttttaatcaactcttcaaggaaaacagaaaagtctctaagaagacactgatcgattttcttaataacagcgaaggaatttacaccgacaaactggttggcatcgatgaggaggtgaagtatctcaacgcctccctggggacctaccacgacctgaaaaagatccttgaatctttcatggatgacgagattaatgagaaaatcattgaagatatcattcagacactcaccctgtttgaagacatcgagatgaagcgccagcggctgcagaagtacgacgatatcttcacacccaaacagctcaaggagctggctagacgcaactatacgggatggggccggcttagctacaaactgattaatgggatcagaaacaaggaaaataacaaaaccattctcgactatctgaagaatggaaaccggaattttatgcagctgatcaacgatgaccgcctttccttcaagcaaattatcatcgatgccagaaaaattgagaagctcgacaatatcgaaagcgtggtctacaacctgccgggctctcctgctattaaaaagggcatcctgcagtccattaaaatcgtggatgagctcgttaaggtgatggggcataatcccgacaacatcgtcattgaaatggcccgggagaatcagacaaccaaccagggcaaaaacagaagccaacagcgcctgaagcggcttcaggattctatgtccaattttaaggacagctccatctctctgaaagatgtggacaacagcgacctccagaatgatagactgttcctgtattacattcaaaacggaaaggacatgtatacaggggaggaacttgatatcgaccacctctccgattacgacattgatcatatcattcctcagtctttcatcaaagacaatagcatcgataaccgcgttctgacctccagcgcgaagaatagaggaaaatctgacgatgtgcccggccgggacgtcgtgctgaagatgaagcccttttggaaaaagctctacgatgtcaaactgatttccaagcgcaaattcgacaaccttaccaagagcgagcacgggggcctgacggaatctgacaaggccggatttatcaaaagacagctcgtggagacacggcaaattaccaagtatgttgctcagatcctggatggccgcttcaatacaaaaagagacgataacaataaggtgattcgggacgtcaaagtgatcaccctgaagtccagccttgtttctcagtttcgcaaggatttcgggttttacaaagtgagagagatcaacgactatcatcacgcccacgatgcttacctgaatgccgtcgtgggaacggcgattctcaagaaatatcctaagctggccccggaatttgtgtacggcgagtataaaaagtgcgacgttcggaagctcatcgctaaaagcggggataagtccgaaattggaaaagccacagctaagtactttttctacagcaacctgatgaatttcttcaaacgcgtcatcagatattctaacggcatgattgtggtgcggcccgtcatcgagtactccaaggacaccggggaaatcgcctgggataaagagaaggacttcaagacagtgtgtaaagttcttagctgccctcaggtgaacattgtcaagaaagtggagaagcaatcccatggcctggatagaggaaaacccaagggcttttataatgccaacccttctcccaagccgaaaaaggggagcaaagttaatctcgtgcctatcaaggctaacctgaatcccaaaaactacggaggctatgcggggatttccaattcttacgccgtcctggtggacgctaccatcgaaaagggagccaagaaaaagctcacccgcattcaggagttccagggcatcagcattatcgaccgggaaaaatatgagaagaacaaagttgaatttctgaaggggctcggctacaaggagatctactccattatcacactgcctaaatattctctcttcgagctggccgatggaagcagacgcatgcttgcttccattctgagcacgaataacaagcggggcgaaatccacaaagggaatgagctcgtgctgcccgccaagtacattcctctgctttatcatgcgaacagaatccacaatacctttgaaacaggacaccgcgagtacgtcgaaaaacatatcgctgagttcaaggagattgccgaaatcattctggagtttaacaataaatatgtgaacgccaagaaaaattcttccatcattgaaaaagctctcgagagcttcgactctttttccctggatgagatctgtgacagcttcgtgggcaagctcaaaaagaacaacaccaaaaagaactctgggctgtttgaacttgtctccctgggaagcgcctccgatttcgagtttctggaaacaaaggttccccggtacagagactataccccgagctctctcctgaatgcgacgcttatccaccagagcattacaggcctgtacgagacccgcatcgatctctccaaactgggggaagagtga

SEQ ID NO: 4444 - RNA, 4197 nt, synthetic construct
  misc_feature 1..4197: note = Cas9 variant
  source 1..4197: mol_type = other RNA
atggagacccaggccagcaaccaactgatctcctctcacctcaagggctaccccattaaagactatttcgtggggctggatatcggaacaagctccgtcggctgggctgttacgaataaggcctacgaacttctgaaatttagatctcataagatgtgggggagcagactcttcgacgagggagaatccgcggtggctcgcagaggctttcggtctatgcgcagacggctggagcgcagaaaacttcggctgaagctcctggaggaactgttcgccgatgccatggctcaggtggaccctacctttttcatgcgcctcagagagagcaagtatcactacgaagataaaacaaccgggcattccagcaagcacattctgtttatcgacaaaaactatacagatcaggactactataaggcctacccgaccatttaccatcttcgggctgagctgatgaaagatggaacatatgacatccgcaaactcttcctggccgtccaccacatccttaagtacagaggcaattttctgtatgaaggcgcgtctttcgattccaacgccagcaccctcgacgatgtgctgaaacaggctctggagaatattacgtttaactgcttcgactcttccgccgctatcgggagcattggacaaatcctcatggagaccggcaagacaaaatctgacaaggccaaaaccattgaacggctggttgatacatacatcattaccgacgaggtgaatgcgtccgggaagacgcagaaagatcaggtcaaggaagacaagaaacgccttaaggcctttgctaacctggtgctcggactgaatgccagccttatcgatctgttcggctccgttgaggaactcgaggaggacctgaaaaagctgcagatcacaggggatacctatgacgataaaagagacgaactcgctaaggcctggtctgatgagatttacatcattgacgactgtaagagcgtgtatgatgccatcattctgctttccatcaaagaacccggactgacaatcagcgagtctaaggtcaaggctttcaacaagcataaagacgatctcgcgattctgaagtcccttctcaagagcgaccggtctatctacaatgccatgtttaaagtggatgaaaagggcctgcacaactacgtgcattatattaaacaaggcagaaccgaggagaccagctgcaatcgcgaagacttctacaagtataccaaaaaggtcgttgaggggctgcctgattccaaggacaaagaatacatcctgtctgagattgaactccagacgctgcttcccctgcagcggatcaaggataacggagtgatcccttatcagctccacctggaggagctgaaagtgattcttgctaagtgtggccccaaatttcctttcctcaatgaagtcgccgacgggtttagcgtggccgagaagctgatcaaaatgctggagttccggattccgtactatgttggacccctcaacacctcccacaacgtggataatggcgggtttgcttgggccgtccgcaaggcgagcggacgggtgacaccttggaacttcgacgataagatcgacagagaaaaatctgctgccgcctttattaagaatctgaccaacaaatgcacataccttctgggcgaggacgttctccccaagtccagcctgctgtactctgagttcatgcttctcaatgaactgaacaatgtgcgcatcgatggcaaacctctggaaaccaaggtcaaggctcatctcattaaagccgtgtttaagcaagaccacaaaaagatgacgaaaaaccggatcgagcagttcctgaaggataataactatatccccgaaaagcataaaccggagattacagggcttgacggagagatcaagaatgatctggcttcctacagagacatggtccgcattctcggcaacaattttgatctgagcatggccgaagagatcattaccgacatcaccatcttcggggaatccaaaaagatgctgcgggagacacttcgcaaaaagttcgcgtcttgtctcgatgacgaagccattaagaaactgagcaagctgagatatcgggattggggaagactctccaaaaagctgcttaacggcatcgacgggtgcgataaagctggcgacggaacctctgtgacaattatcgaggccatgcgggactttagctacaatctgatggagctcctgggcgatcgcttcctgtttatggaacggattcaggagatcaacgacaaacttacggaagggcaaatcgttaaccctcacgatattatcgacgatctcgctctgtcccccgccgtgaaaagagcggtctggcaggccctgagaattgtggacgagatcgttcatattaagaaggctctccctgcccgcatcttcgtggaagtcacccggagcaataaagctgagaagaaaaagaaagattctagacagaagcgcctgtccgacctttatgccgccatcaagaaagatgacgctctgctcagcggactgacaaacgaggaatttggcgggctgaagtctgagcttgcgaaatacgatgacgccgctctgagatccaagaaactctatctgtactacacccagatgggacggtgtgcctatacaggcgaagtgattgacctcagccaactgaataccgataactacgacatcgatcacatttatccccgctctcttacgaaggacgatagcttcgacaatctggtgctctgcaagagaaccgccaacgctcagaaatccgatacataccccatcagcaaggagattcagaaagcccagaaggcgttttggatcttcctgaaacaacaggggctgatttctgagcggaagtatgaacgccttaccagaatcacacctctgaccgctgacgatctctccggctttatcgcccggcagctggttgagacgaatcagagcgtcaaggccgctacaaccctcctgcgcagactttacccggacattgatgtggtgttcgtcaaagccgaaaacgtgacagactttcggcacgataataacttcatcaaggttcgctccctgaatcatcaccatcacgcgaaagacgcttatctcaacattgtggtcggaaatgtgtaccacgagaagtttaccagaaacttccgggccttctttaaaaagaatggcgccaacagaacctacaacctggctaagatgttcaattatgacgttaaatgtacaaacgccaaggatgggaaggcttgggacgtgaagacgtctatggataccgtcaataaaatgatgacaagcaacgacgtgcgcgttaccaagcggctgcttgaacaatccggagccctggcggatgccacagtgtacaaagctaccgtcgccgctaaggccaaggacggcgcctatatcgggatgaaaacgaagtctagcgtgtttgctgatgtgacaaaatacggaggcatgaccaagattaaaaatgcgtattccatcatcgtccagtacattgggaagaagggcgaggttgtgaaagagatcgtgcccctccctatttatctgaccaacagaaatatcacagaccaggatctcattgactacgtcgcctctatcacaccccaggctaaggatatcagcattatctaccgcaaactgtgcattaaccaacttgtgaaggttaatggattctattactatctgggcgggaaaacaaactccaatatctacattgacaacgccgtggaagtcgtggttcctgccaatatcgctgtgtatattaaggtcctggagaagtttgccctcctgcataaagataacaataacatcaaggcgagcacggtgaccacacggatctacaacgaaggatctaccaatattgtttccatcacagacaaagacggccttattgtgtatgattacctgatgagcaagctcagaacgcccctgtacatgaaaatgaaggggaacaaggtcgacgagctctctaccgtgggacgctccaaattcatgaatatgaccctggaggaacagagcatctatcttctggaggtgctgaacctcctgacaaattctaagaccacatttgatgtcaaagctcttggcattaccgcctcccggagcacaatcggggttaagatccacaccctggacgagttcaaaattatcaaccagtccattacgggcctctacagcaatgaaatcacaattgtgtga

SEQ ID NO: 4445 - RNA, 4197 nt, synthetic construct
  misc_feature 1..4197: note = Cas9 variant
  source 1..4197: mol_type = other RNA
atggagacccagacaagcaaccaactgatcacgtcccacctcaaggactaccccaaacaggattatttcgtgggcctggacattgggaccaattctgtcggatgggccgttacaaacaccagctacgaacttctgaagtttcattcccacaaaatgtggggctctagactcttcgaggaaggggagagcgctgtgacacggcgcggatttagatccatgcggcgcagactggaacggcgcaaacttagactgaaactcctggaggagctgttcgccgatgcgatggctcaggtggactctacctttttcatccggctccatgaaagcaagtatcactacgaggataagacaaccggccattccagcaaacacattctgtttatcgacgaagattatacggaccaggattacttcaccgagtatcctacaatttaccaccttcgcaaggacctgatggagaatgggaccgatgacatcagaaaactctttctggccgtccatcacatccttaagtaccggggaaacttcctgtatgaaggcgccacatttaattctaacgctttcacctttgaggatgtgctcaaacaagccctggttaatattacgttcaactgcttcgacacaaattccgctatcagctctatttccaacatcctgatggaaagcggcaagaccaagtctgacaaagccaaggcgattgagcgcctcgtggatacatacaccgtctttgacgaagtgaataccccggataaaccccagaaggagcaggttaaagaggacaagaaaacactgaaggccttcgctaaccttgtgctggggctctccgccaatctgatcgatctttttggaagcgtcgaagacattgatgacgatctgaagaaactccagatcgtgggcgacacgtatgatgagaagagagacgaactggctaaagtgtggggagacgagatccatattatcgatgactgtaagtccgtctacgatgccattatcctgatgtctattaaagaacctgggctcaccatcagccaatccaaggttaaggcgttcgacaaacacaaggaggatctggtgatccttaaaagcctgctcaagctggaccggaacgtgtataatgagatgtttaaatctgataagaagggccttcacaactacgtccattatattaaacaggggcgcacagaagagacctcctgcagcagagaagacttctacaagtacaccaaaaagatcgtggagggactggccgattctaaagacaaggaatatattctcaacgagatcgagctgcagacactgctccccctgcagcggattaaggataatggcgttatcccttaccaacttcacctggaggagctcaaagtgatcctggacaagtgtggccccaaatttcctttcctgcatacggtcagcgatgggttttccgtgacagaaaaacttattaaaatgctcgagttcagaatcccgtattacgttggacccctgaacacccaccataatattgacaacggcgggttttcttgggctgtgcgcaagcaggccggacgggtcaccccttggaatttcgaggaaaagatcgacagagaaaagagcgctgccgcctttattaagaacctgacaaataaatgcacctatctcttcggcgaagatgtgctgcccaagtccagccttctgtactctgagttcatgctcctgaacgaactgaataacgtccgcatcgacgggaaagctcttgcgcagggagtgaagcaacacctcattgattccatctttaaacaggaccacaagaagatgacaaagaatcggatcgagctgttcctgaaggataacaattatattacgaaaaagcataaacctgagatcaccggcctcgacggcgaaattaagaacgatctgacaagctacagagacatggttcgcatccttgggaataactttgatgtgtctatggccgaggacattatcaccgatatcacaattttcggagaatccaagaaaatgctgcggcagaccctcagaaacaagtttggcagccagctgaatgacgagacgatcaaaaagctgtccaaacttcgctaccgggattgggggagactctctaagaagctgctgaaaggaattgacggctgtgacaaggctgggaacggcgcccccaaaaccatcattgaactcatgcgcaatgatagctataacctgatggagatccttggagacaagttctcctttatggagtgcatcgaagaggaaaatgccaaactggctcaaggccaggtcgtgaacccgcacgatattatcgacgagctcgccctgtctcctgcggttaagcgggctgtgtggcaggccctgagaattgtcgatgaagtggcccatatcaaaaaggcccttcccagccggattttcgtggaggttgctcgcacaaataagtccgagaaaaagaaaaaggacagcagacagaaacggctctctgatctgtactccgctatcaagaaggacgatgtcctgcaaagcgggctccaggacaaagaatttggagccctgaagtctggccttgcgaactatgatgacgccgctctgagatccaaaaagctctacctgtattacacccagatggggcgctgtgcctatacaggaaatatcattgacctgaaccagcttaataccgataactacgacatcgatcacatttaccctcggagcctgacgaaagacgattctttcgacaatctcgtgctgtgcgagagaacagctaacgccaaaaagagcgatatctatcccattgacaatcgcatccaaaccaaacagaagcccttttgggcgttcctcaaacaccagggcctgatttccgaaagaaagtacgagcggcttacacgcatcgcccctctgaccgctgatgacctcagcgggtttatcgccagacagctggtggagaccaaccaatctgtcaaagctacaacgaccctgcttcggcgcctgtatccggatattgacgtggttttcgtgaaggccgaaaacgtctccgatttcagacataataacaattttatcaaggtgcggagcctcaaccaccatcaccatgccaaagacgcttacctgaatattgttgtgggcaacgtctatcacgagaagttcacacgcaattttagactcttctttaaaaagaacggagcgaatcggacctacaacctggccaaaatgttcaattatgacgtgatctgtacaaacgctcaggatggcaaggcctgggacgttaagacctccatgaatacggtgaaaaagatgatggcctctaacgatgtccgcgtgacaagacggcttctggaacagagcggggctctcgccgacgcgaccatttacaaggcttccgtggccgccaaggctaaagatggagcctacatcggcatgaagaccaaatattctgtctttgcggacgttacaaagtacgggggaatgaccaagatcaaaaatgcttatagcattatcgtgcaatacacaggcaagaaaggggaggaaattaaggagatcgtgcccctgcctatttatctgatcaacagaaacgccacggatatcgagcttattgactacgtcaaatccgtgatccccaaggccaaggatatttctatcaaatatcgcaagctgtgcattaatcagctcgttaaagtgaacggcttctactactatctgggaggcaagaccaatgacaaaatctacattgataacgctatcgaactcgtcgtgcctcacgacatcgccacatatattaagctgcttgataagtacgacctgctgcggaaagagaataagaccctcaaagctagctccatcacaaccagcatttataacatcaatacgtctaccgttgtgtccctgagcaacaaggtcgggattgacgtgtttgattacttcatgtctaaacttagaacacccctgtatatgaagatgaagggaaataaagttgacgaactctccagcaccggccgctctaagtttatcaaaatgacactggaggaacagtccatctacctcctggaggtgcttaacctgctgaccaatagcaagacaaccttcgatgtcaaaccgctcgggattacgggatcccggagcacaatcggcgtgaagattcataacctggacgagttcaaaatcattaatgaatctatcaccgggctttacagcaacgaggtgaccatcgtctga

SEQ ID NO: 4446 - RNA, 4200 nt, synthetic construct
  misc_feature 1..4200: note = Cas9 variant
  source 1..4200: mol_type = other RNA
atgaagaccatcctgggcctcgacctggggacaacgagcattggatgggcccttgtgaaagaggctgaacccttctccgatgagaagtctgaaatcgtcagactgggcgttcgggtgattcctctcaccgtggacgagcgcaccagctttgaaaacgggaaatccatcacaacaaatgccctgagaacccagaagcggggaatgcgcagaaaccttcaacggtacaaactgcgcagacaggcgctcattgaggagctgaagtctacaggctggatcgggaatgatttcatctttagcgaaaccggaccgggctccacgttccggaccctgcgcctcagagctaagtctgccagcgaggaagtcacactgggcgaccttgcccggattctgctccagatcaacaaaaagcgcgggtataaatccagcagaaagatggtgtcttccgatgacggacaggctattgatggcatggccgttgctaaagagatgtacgacaaggggctgacccccggagagtatgtgtaccaacggatgcttgaaggcaagtatgccatccctgagttttacaaaagcgatctgcaggaagagttcgaccgcatttgggcgctccagaagtcttttcacatcgaactgacagatgagctgtatagaaaactctccgaccggaataagagccagacctgggccatttgcagagatgagctggggatccaaggacttaaatcttccttcatcggcaaggaacgcctgaaagaggcttaccggtacagacatctcgccgctacgcaggaagtcaacatggaggtgctgacatgtgcccttcaggaaattaatggccagaaggcgagcctgtccgggctcctgtctaagatcagcgaccgctccaaagagctgtatctcaacaatctgaccgttggacaaatgcttctgaagcggattgaggacaaccccaataacagcctcaaaaatatcgtgttttacagacaggattatctggacgaatttgagcgcatttggacagtccagtctaagtaccacaccgaacttacccatgagctgaaaaagcggctcagagatatcatcattttctatcaacgccctctgaagtcccagaaaggcctgatcagcctctgcgaactggagacaaaggacattgaggtggccatcgatggggtgaaaaagatgaaaaacattggaccccgggtctgtcctagatctagcccgcttttccaggaatttaagatctggcagacgatcaataacattttcgttaacggcgctgccctggacgatgaggacaagtccgtgatcgctaaagaactcatgttcaaggataaactgaaggactctgatctgcttaaactcctgtttaagaccacaaaggggcaaagcgtgaatttcaaagaggtcgacggaaaccgcaccatggccacactgatgaaggcctgctttaaaattgctgagaatctcggctacgacgatatcggcctgtccaaacttagctctgaagaccagatggtgcggattgaggggatcttcaaggaacagggatttaagaccggcttcctgcactttgattccagcctcgcgtctcccgagttcgaaaaccaggactcctatagactgtggcatctgctttacagctacgagggggataaatccgcctctggaaatgagagcctcgttaagtgtattatggacctgtgctccatggatgaaggctctgctaagatcctggccagctgtacgtttctccctgactatgggtccctgagcgccaaagctatgcggaagatccttccctacatgaaagatggcctggagtatacagccgcgtgcgctatggccggataccgccactctaagagatccctcaccaaagaggaactggacaccaaggaatatagcgatcggctgtctcttctccctaagaactccctgagaaatcccgtggtcgagaaaattctgaaccaaatgatcaatgtggttaacagcgtgattgacgtctacggcaagccggatgagatccgcattgaaatggcccgggagctcaaaaagtctgctaaagaaagagaggaagcccagcgcgacatcgctagctccacagccgagagccagaaggtgatcgagattctgaagggggaacctttctttcttcagttccccaccagaaatgacatcattcggtatcgcctgtaccaagagctcgcgcagaacggatttaaaacactgtactctaatacgtatatccctaaggataaactgttctccaaggaatttgacattgagcacatcatcccccaggcccttatttttaacgatagcttcgctaataaaaccctcgagtccagacagtgtaacctggaaaagggcaaggagacagccatggactacgtcaaatctaagtatgatgaaaccggggtgcaaacatactgcgaccgggttaacggactgatcggcaaagggattagcaagaccaaagctaagtggctcctgatggagggcaaagatatccccgaagactttattaatcgcgagcttagagattcccagtatatcgccaagaaggcgcgggagatcctggaatctctcgtgaaattcgtcgtgcctacgaccggaagcgttacagcccgcctgagagaggactggcagctggtgaacgtcatgcaagaacttaattgggagaagtacgctcggctgggcctcaccggggtgcgcgaagataaagacggaagacggattccgtttatccaggattggacaaagagaaacgaccatcgccaccatgccatggacgctctgaccattgccttcacgcggagacagtttatccagtatctcaatcacctgaactccaaaattgatgtggtttcttgggacaagaaggatcttgacctgcgcgattacgacctcgaggatatcaaattcggcaatctgagcgccggggaccggtacggaattgtcaaggctctgcaagataaatttctttataaggacggcaacgataaatacagattcgtgccccctatccccctggacgagtttcgccggcaggcgaaggaacagctctccgacatcctgattagcttcaaggccaaaaataaggtgtgtacaagaaacgtcaatgtgaccaaaaacaagggcggcgctaatcgcaaagcccagctcacacctcggggacccctgcacaacgagaccatctatgggtcttcccttgaatacgttaccaaggagaatgaaaagattgggagctcttttgatacagagagaatcacgaccgtgtgcaaaaagaaattccgggacgccctggctcgcagactcgaggagttcggaggcgatccgaagaaagcctttacagggaagaactcccctgaaaagaaccccatttgggtcgacgaacatcacagcgagcaagtgcctgcgaaagttcggaccgtgacaatgggacagcgcttcaccggcagaaagcccatcgatgctacgctgaaaatcgagaaggtcattgacaaacggatcagagaaattctgcaggcccgccttgatgagtttgacgggaaggccgctaaagccttctctaatctggatgaaaaccctatctggctcaataaggagaagggcattgcgatcaaacgggtgacagtttccggacccgctaacccggtgcctgtcagatttaagcgcgacaaagatggcaagcccatcattgacgatgccgggaaaaccatcggagccgacttcgtgacccccggcaataaccatcacattgctatctttcgggacagctccgggaagctgcaggaacatcctgtgagcttcctcgaggccacaattgctaagtctcacggactggatgtcatcgacagaaattataacaaagatgagggctgggaatttcttttcaccctgaagcaaaatgagtactttgttttcccgaacagcgaaacaggcttcaatcccctggactatgatctcacggaccctcgcaactacgccgagatttcccccaatctgtaccgggtgcagtctatcagcaccaacgattatttcttcagacaccatcttgaaacaacctccgagaaaaataactctctgtacgggatcacatggaagcgcattagaaacgcgagcgccctcgagggactggtgaaagtccggatcgacaatctcggccgcattgtggctgttggggaatatgattga

SEQ ID NO: 4447 - RNA, 4200 nt, synthetic construct
  misc_feature 1..4200: note = Cas9 variant
  source 1..4200: mol_type = other RNA
atggagacccaggccacagctcaactgatcagcggccacctcaaggggtaccccatttatgactacttcgtgggactggatatcggcacgaactccgtcgggtgggccgttaccaatagaatttatgaacttctgaaatttcggtctcataagatgtggggaagccgcctcttcgaggaaggccagacagcggtggtgagacgggggtttcgctccatcagacggcgcctggagagacggcgccttagactgaaactcctggaagctctgttcgccgacgccatggctcgggtcgattctacctttttcattcgcctcagagagagcaagtaccactatgaggacaaaacaaccggacataagtccaagcacatcctgtttatcgatgacaactacacagatcaggactatttcgccgaataccctaccatttaccatcttcgggctgatctgatggagaatggcacgtctgacatccgcaaactctttctggccgtgcaccacattcttaagtatagaggcaacttcctgtacgaaggggcgacctttgatagcaattccagcctcgacacagttctgaaacgggccctggagcagatcgagttccatatttttaacgctacctctgaagatgccctccactccatcctggacattgtgaaacttcaagacaagacaaagagcgataaggctaaagccatcgagtctctggtcgacacctatatcacggataaggtggaatccagctgcacagacaaagagaagaaagatctcctgaaggcggacaaaaagagacttcgcgccttcgctaatctgattctcggactgaacgccaatctgaccgatctcttcggcacaatcgaagagattgaggaagactttgttaagctgcagatcaccggggatacctacgaggaaaaacgggacgattatgctaaggtgtggggagacacaattagaatcatcgacgattgtaaatctgtctacgactccattatccttatgagcattaaggagccgggcctgacgatctcccagtctaaagtgaaggccttcaacaagcataaagaagatctcgccattctgaagcgccttctgaaaagcgacaagtatatctacaaaaatatgtttaaggctgatgagaaggggctcgcgaactacgtgcactatatcaaacagggacggaagaatgagaccggctgctcctgtgaagacttctacaaatatacaaagaaagtcgttgagagcctgcccgattcttccgacaaggcctacattctgaacgaaatcgagctccaaaagctgcttcctctgcagagaattaaagataatggcgtgatcccctatcagctccacctggaagaactgaaggctattcttgagaaatgcaaggacacctttcctttcctcaacacagtgagcgatgggtttaccgtcgccgaaaaactgatcaagatgctggagttccgcattccctactatgtgggacctctcaacccgtctcatagcatcgacaaaggcgggtttgcctgggttgaacggaaggagcccggacaggtgacgccttggaatttcgaggataagatcgacagagaaaaatccgctgaggcctttattaagaacctgacaaataaatgtacctaccttatcggcgaagacgtcctgcccaagtctagcctcctgtactccgagttcatgctgcttaacgaactcaataacctgcgcattgatgggaaacctctggagcaagcggtgaagatgcacctcatcgacgctgtttttaagaaagagcataagaaacagaccaagaatcggattatcgagttcctgaaagataacaattatatccttggaaagcacaagcccgaggtggacggcctggatgaaagcattaaaggcgacctcgcctcttacagagatatgaagcgcatcctgggggacgatttcgacgtctccatggccgagagcattatcacatctattaccatctttggagaatccaaaaacatgctgcgggagacacttagaaagaaattcggcagcatcctctccgaggatcagattcggtctctggctaagctgcgctatagagactgggggcggctcagcaagaaatttctgatcggaattgatggctgcgtgaagggggaagacggcacgccgggaaccatcattgacatgatgagaaatacatcccataaccttatggagctgctcggcgataccttctcttttatggacgtcatcatcgaagagaatgataaactgacaaaggggcaagtggttgaccctcacgaaattatcgaggagctgggacttagccccgccgtgaaacgcgctgtctggcaggccctccggattgtggatgaagttatccacattaagaaagcgctgccttccagaatcttcgtggaggtcgcccgcaccaacaaggacgaaaagaaaaagaaagatagcagaaagaaacggctgcaggagctctacaagtctattcagaaggagtcccccgaatggctgagcgtgacgcgcgacgagtctgataaacttatctccaatctggacagagctgatgacagctctctccggagcaagaaactgtatctgtactatacccaaatgggccgctgtatgtactccgggagagtgatcgaccttgatcagctgaacacagacaagtacgatattgaccatatctatccccggagcctcaccaaagatgactcttttgataacctggttctctgcgaacgccaggagaatgccaagaagtccgacaactaccctattgatccggacatccagaatgctagaaaacccttctggacatttctgaaggatcaaaaccttattagctcccggaaatatgaacgcctgaccagagtcctccctctggaggccgacgatctgacgggattcatcgcgcggcagcttgtggagacaaatcagtctgtgaaggccgtcaccacactgctcagacgcctgtaccccggcgtggacgttgtgtttgtcaaagctgaaaacgtgaccgacttccggcacgataatgactttatcaaggttagaagcctcaaccatcaccaccatgccaaggatgcttatctgaatattgtggtcgggaacgtgtaccacgagaaattcacccgcaatttccggaagtttcttaaaaagaacggcgccaaaagaacatataatctggcccgcatgttcgactttgatgttatgtccacgaacgctaaggacggaaaggcgtgggatatcaaaacctctatgaatattgtgaagaaaatgatggccagcaacgacgtccgggtgacaaagagactcatggaacagaaaggcgctctgtccgatgccaccgtgtacaaggcctctgtcgctgggaaagccaagggaggcgcgtacatcgggatgaagacaaaagacagcgttttctccgatgtgagcaagtatggaggccgcacctctattaaaaacgcttactccatcgtggtcgagtatacggggaagaaaaatgaaatcattaaggagatcgtgcctctgcccgtttaccttattaaccggaataagacagaccaagagctgatccattatattgtgagcatcattccgcaggccaaaaacgtctctatcatctacaagaaactctgtattaatcagctggtgaaggttaacggcttttattactacctcggaggcaaaaccaataactatttctggatcgattccgccattcaggtggtcatcgctgacgaatggattccttacctgaaggtgcttgagaagtttgacgttatgagaaaacaaaataaggaactgaaagtggggaccgtcagcacatctatccagaaccagggaaagaaagtggtgatcaagattctggaggaacggaatgtcgagttcttttcctatctcgttggcaagctgcacagctccatctacagcaaaatgaaggggaacaaagccggagagcttgcgaccaagtctctggaaattttcgtgaatatgagcctcgagaaccaatgcatctatctgatggaactcctgaatcttctgacaaacaaaaaggctcccgatgtgaaacctctgggcattacggcctcccgcgggaccatcggctctaaggtcagcaaccaggacgagtttaagatcattaatgagtccatcacaggactctactctaacgaagtgaccattgtttga

SEQ ID NO: 4448 - RNA, 4200 nt, synthetic construct
  misc_feature 1..4200: note = Cas9 variant
  source 1..4200: mol_type = other RNA
atgaacctgagaaataccacagacgagtacaacatcggcctcgatatggggacgaatagcgtgggatgggccgtcaccgacaaggctggcgccattgcgcacttcaaggggaagcccacactgggatcccggctttttgatgctgcccagaccgccgctggcgcccgcatccatagatctcaacggcgcagatatgttcggcgcagatggcggctggacctcctgcagagccttttccaggatgaagtgtccaaagtggactctgagtttttctgccgcctgagacagagccggctctacgtcggggatcgcgaaaagggacacgctgactatacatggcctatttttaacgattccgacttcaatgaggtggattactataaaagatttccgaccatctaccatctgcggaagtggctgatggaaacagacgagaaggccgatattcgcctcatctatctggcgacccacaacatcgttaaacatagaggcaatttccttcgggagaacaataagtctctgagctccagagacgccaaccccgctcaagccgtgaaaagcctccgcctggctcttaatgactggtgttctgaacgggattacgagtgcgcctggaagggcgaagaggacgatggggcgattgacgaggccatcctgaacgtcctcgctgatggagaaaaaggcagatccgaccaggccaaggagattgctaagctgacgggggtggattgtggagacgccaaacagagcaagcagtgcaatgaagccatcgctaaagcgattgttggcctgaaggtggagatgaaaaacatctttggggagttccctgccgaaaagacctcttacatttatctctccagcgatgaggacgtcgaagctgtgcgcgagtcttgtcccgatgactccggagaactgtttcaagccctttgcaaactgtacagcgcctatatcctccaggagctgctttcctacgctgacccttctggccagacaatcagcgccaatatggtggcgaagtataagcagtacggccgggatctgagactcctgaaagaactgacccgcacatatgctccccaaaagtacgacctcttctttagaggggagacctacgccggatccagcgattatgtcgttgacgaggccagaggctacacgcgctataacctggggacaaccaaagctaactacgatgacttccagaagtctgtgaaagaacttttcaagggaacagatgccctgcaggacgagcggtatcaagaaatgatggtggcttttggcgagcagaagttcctcagacgcctgaaaacctccgataatgggagcatttactatcagcttcacctggaggaactccacaccatcctggagaaccagggaaagcattacccttttctgctctctgaagaggacaaaattgaaagcctggtctccttccggatcccgtactatgtgggcccccttacaagaaagaatgccgcgattggccacgatgggaaagagcggtttgcctggtctagccgcaaggacggaatggagcatgctgttatcacgccttggaactgggaagagatcattgatagagacaagtccgccgaagacttcatcatgcggatgaccggcgattgtacatacctgcaaggggagcccgtgctccctaaatgcagcctgctgtatgaagagttttgtgctcttaatgagttcaacggagcccactggaccgtcgacggcgatgacgaaagacgctttgatgcggcccagcgggagagaattatgtgcgacctcttccgcagaacacggtctgtgacctacaataaggtttccgattggctggaacgcaaatataactttacgggggctagagtgcggggcggacagggcgagcacgggttcgaaagcaagctgggatcttacatctttttctgtaaagacgtcttcaagacagatggcctcgacgaggccgattataccatgattgagcagatcatcctgtggtccaccctttttgaagaccgcgatattctgaagagaaaaatcgaggaggcttacgggggagaccggctcacaagcgaacaaattaaggtgatctgcaaaaagcgcttcaccggctgggggagactgtccaaacggctgcttacagacattaaggtcaatacggataccggccgcaaatctatcatggacgtgctcagagaaggaaaccccaataacggccagcggagcagaacaatggtttttatggaggtgctgcgcgatgaggacctggggttccagaaggccattgatggactcaatcgggactactttagagaacataacaatggcctgatggatgtcaacgaccttccggggtcccctgccatccgccggtctatcaaccaggctgtgagaattgttgatgagatcgcgagcattgcccgcaaggaacccaccaatatcttcattgaggtgacacgggaggaagacgatcctcggaaaaagggaaaacgcaccaagcggagatatgacgctatcaaatccgccctggagaagtttaagaaagacgatcccagcctctggaaggaactgtgcgagaaagcccccggcgacatggatgaacggctgtctctttacttcatgcaacgcgggaagtgtatgtattccggcagacctatcaaaattgaggagctccacacgggaaagtacgaagtcgaccatatcattccgcggagctatatcaaggatgactcttttgagaacaaagtgctggtgtaccgcgaagagaatcagcacaagaccgatgctctgctcattgactccagcatcagacagaaaatgggcgggtattggcggatgctgcatgatgccaaacttgttggagacaaaaagttcagaaacctgtttcgcaatcacatcgatgacaaggcgatgaaaggcttcgtcgctcggcagattgtggaaacatctcaaatggtgaagctcgtccagaccctgtttgaggccagataccccaacacacgcatcgtgcctgttaaagccgggattagccacgatctgcgggaggctgccggacttgtgaagtgcagagaagcgaatgacttccatcacgctcatgacgccttcctcgcctgtcgcatcggcctgtttattcagaaacggcacccctccgtctacgataaccctatcgggctggctagaatcatgcgcgactatgccagaatgcaagctcgggagtacaagaaaagccactgcctcgcccatacccagggcttcattgttaattcttttctgtccagcggattcgatgaagagacgggcgaaatctttaaggacgattgggacgcgaaggccgaggtggaggggattcgcagagtgcttaactgtcggcagtgcttcatctcccgcatgcccgtcgaaggagatacaagatatggcgggcggtactggggagagaccatttattctccgaaaggcaagcacaaacatgaaatccctctgaagcagggcctcgaccccaatctgtacgggggatatagcgatctgctttactcctactttctgatttatgaggcttctgacgtgagctccggcgagagagttctccgcttcatcgggatccctacatctattgccgctcggatggccaaccaaaagagactggaagagtacgtgagccgcctcgccctgcaggaaaatcttgagcacgtccggatggtgagaaagatcatgaagaaacagctgattgaagtggataactgtcggctcctggtcaccgctgcggacgccgttaccaatgctacagagctggccttttcccttgatgagatgaagatcattagcacgtgcgccaaatgtatcaacggagctgacccctctgccatcgacaagattggcaacgcgcaggattccttctttgacaatctgaaacgcagagggagcgatcggtgcgctctcctgttctctcaactcaagctggacaaactttcccagaacttctatatgatcagctctgatgacaagtccaagattctgatcagcattctcgatcgcatcagagccaaatccaatagcgtggacctgtctctggtgggaggcgccaagcatgctgcccagatgaaatttgatttcaacgcgaaacttaataaccctgctagctcctttgtcctgatcgaccagtctgtgaccggcatgttcgaacggcgcacaagaattgggctctga

SEQ ID NO: 4449 - RNA, 4203 nt, synthetic construct
  misc_feature 1..4203: note = Cas9 variant
  source 1..4203: mol_type = other RNA
atgaacctgagaaatgccaccggcgactacagcatcgggctcgatctgggaacaaactccgtgggctgggctgtcacggactctaatgggagcatggcccacttcaagggaaaacccacccttggctcccggctgtttgatgcggctgagacagccgccggggctcgccagcatagaggacaacggcgcagatatgttcggcgcagatggcggctcgacctgcttcagggcctgttccaggatgaagtgaacaaggtggactctgagtttttcattcgcctcagacagagccggctgcacgtcgaagatcgcgccgagggccatgctgggtacagatggcctctgtttaatgacaccgatttcacagaaaaagactattacaagcggtttccgaccatctatcacctccgcaaatggctgatggagacagatgagaaggccgacattagacttatctacctggcggcccataacattgtgaagcaccggggaaatttcctcagagaagataacaaaaatctgtcctctcacaacgctaatcccgccgaggctgttcgcagccttcggcaagccctggacgactggtgcgcggaaagaggctatgtgtgtgcctggacctccgtcgatgacctcgctgaggccgatagccatatcctggacatcctgacgaactctaaggagcgccgggctgatcaggccaaagaactcgccaagctgtttggggtggactgcggagataccaaacagtccaagagctgtaattctgctcttgcgaaggccgttgtgggcctgaaaacagagctcaaggacgtcttcggggaattttgcgctgagaaaaccgccattcacctgtccagcgatgacgatgtggaagccatcagagacgctattcctgacgattctggagagcttttccaggtgctgtgtgccgtctactccgcgtacgttctccaagagctgctgagctatgctcccggccagacaatctccgccaacatggtggccaagtacgaccagtatggcaaagatctcaagctgcttaaaaatctggctcgcacctacgtgtctcgggaaaactatgacgcctttttcagagggcagacgtacgaggatagcaacgactataatgtcgataaggctcaaggatacacacgctacaacctcggcaccacaaaggcctcctatgacgatttcaaaaagagcgtggaaaaactgtttaaggggacccaggcggagcaggacaaacggtaccaaggaatgatgaagagattcgccgaagagaagtttcttcgccggctgaaaacctctgataatggctccatttattaccagctccatctggaggaactgagagctatcctcaagaaccaggggaaacaccaccctttcctgcttgaggaagagaagaaaattgaaagcctggtttcttttcggatcccctattacgtgggacctctcagctccaagaatgcctctctggaccataagggcaaacagcgcttcgcttggagcgagagacggccgggcatgaaggatacagtcatcacgccctggaactgggaccaaattatcgactgcgatcagtccgccgagaaatttattctgagaatgaccggggactgtacatatcttcagggagaacctgtgctccccaagtgcagcctgctgtacgaggaatactgtgttctcaatgagctgaacggcgcgcgctggaccatcgatggggacgattggcggagattcgacgtggcccagcgcgagggcattcttcacgatctgtttagaaaaacacggtctgtcgcttataataaggtggccgactggctcgaacgcgaggaaaactgggctaatgcccatgtcagaggagggcaaggcgagaactccttcgaaagcaagctgggatcttacatctttttctgcaaagatgtgtttaagaccgccgctctggacgaggcggattatcctatgatcgagcagattatcctttggaatacactcttcgaagaccgggccattctgaaacgcaagatcgagcaggcttacggcgaacaccatgggggaaaactgacggatgagcagattaaggttatctgtaaaaagagattcaccggctgggggcggctctcccgcaagctgcttaccggaatcaaagtggacgccgacacaggcagagtcagcattatggatgtgctgcgggaagggaaccccaatgagggccaacgctccagaaccatggttctcatggaggtgctgcgggacgaagatctgggatttcagaagaaaatcgacgatttcaacaaggcctattttgctggccagggggagggacttatgtctgtcaacgacctcccgggcagccctgccattagacgctccatcaatcaggcgattcggatcgtggatgaaattgcttctatcgccgggaaagcccccagcaacgtgttcatcgaggttacaagagaagaggacgatcctcgcaagaagggacggagaacgaatcgccggtacgaggacattaaaaacgctctggaaaattttaagaccgaggatcaagaactgtggtccgagctcctgggcaaagcccccaacgaccttgacgagagactgagcctctatttcatgcagcgcgggaagtgcatgtactctggccggcccatcaaactggaagaactgcacacaggaaagtacgaagtcgatcacattatccctagatcctatattaaggacgatagctttgagaataaagtgcttgtgtgccgggaagagaaccagcgcaagaccaatgagatgctcatcgacccggcgatcagacggcgcatgggcgattactggagaatgctgcataaagctaagctgattggggacaaaaagttcaacaatctctttatgcgggatagaatcgacgataagacactgaaaggattcgtcgcccgccaacttgtggaaacctctcagtccgttaagctggtgcagacgctcctggaggtccggtatcccaacaccaaaattgtgcctgttaaggccaatatcagccacgacctgagagaagctgccgatcttgtgaaatgtcgcgaggctaacgactttcatcacgcccacgatgcgtacctggcctgccgggtcggcctcttcattcagaagagacatccctctgtgtatgctaatcctatcgggctgagccgcgttatgcgggactacgccagaaaacaagctggagaatttaacaagacacactccatggcccataccaagggcttcatcgtgaacagcttcatgacatctgagtttgacaaagagaccggggaaattttctgggatgccgaggctgcggtcgaagacatccgcagagtgctcaattatcggcagtgttttatttcccgcatgcccgtggaggatacgggcgccttctgggaccagacaatctacagcccgagatccaacaagcggctggaacttcctctgaaagatgacctcgatcccaataagtacggatcttatagccgcgagcagtttgcttacttctttatttatgaggccagagacgccaaaaagtccaagaccgtcctgcggttcgctcaagttcctgtgagagtgacatctgccatcgcgcgcgatagctccaaactggacgaatacgcttctggccttgccgtccaggaggggctggaatttaccaagatcattcggagacgcatcctcaaaaagcagctgctcgagctgaacggagatcggcttgtgattaccggcgccaaagaggttagaaatgctacagagttcgcctttacgctggaggaaaccgcgctcgtggctatgtgcagcgagatcgcccgggaaggggtcccctccgagattgccagcgacgtgcagtctatctccagccaactgtctgatctgttccttgctctgattgagcgcggactcacaatcggcgttagactgcacggccagctcaagctggggcagtatcttcggcaattcgaagacgccgctctgcgcgacaaggccaaagtgatcattggaatcatttccatcaccaacggcgcgacaaataccctggatctcagctctctgaacgggtccaagaatgtcggacaggtgagaattacgcataacaaacttctgaatgacaagagcacatcctacgttctcatcgatcagagcgtgaccggcatgtttgagcggcgcaccagaatcgggctgtga

SEQ ID NO: 4450 - RNA, 4203 nt, synthetic construct
  misc_feature 1..4203: note = Cas9 variant
  source 1..4203: mol_type = other RNA
atgaagaccatcacagaggactacattctgggcctcgatatcgggacgaacagctgcggatgggccgtgatggacaaaaagaatagactgcttcggctgcgcggcaaaagagctattgggtcccacctcttcgaagagggacattctgccgcggatcggcgcagctttagaaccacacggcgcagactgaagcggcgcaaatggagacttcggctgctcgaagagttctttgctgaacccatggccaaggtcgaccctgccttctttgttcgcctgcaccagtcctgggtgtctccgctggataaggacagaaagaagtatcatgctatcgtgttccccaccgccaaagaggatcacgagttttaccatgactatcctacaatttaccacctccgggatgctctgatgcgcgaagacagacaattcgatcttcgggagatctttctggccatccaccatattgtcaagtatagaggcaacttcctccaggacacccccgtgaatagctttgttgcgtccaaaatcgatgtggcctctttcctgacaaacgtcaatcaggcttacgccgacaagtatggggaggagcagaactttattgagcttaatgaaaacaatgctgccgcgatcgaggccgtgattcgcggaaaggacaaagataagaccacgaaacaactggacaaggctaaaaagatcaccaaactcctgcagagctccacaaacaagtacgaaaagaatgttacccggcagattgccaacgctatcatcggctacaaaacacagttcgagaccattctgggcaaggatatcgacaaaaatgataaggccgactgggagttcaaactcagcgatggggacgccgatgacaagctggagaaccttctgcctgagtttgatgacaatgaccaatatattgtggctgaaatcaagaaactcttcggatctattgcgctgtcccagatcgtctacgagaacatgacgcttagccagtctatgaagtgtaaatataaggatcacggcgaagactacgatctgctcaaacagtatatcgccacactgtccgaccatagccaagtgagaaagctgctcctggcttacgatctttatgtgaacaatcgccacgggcggctgctcgaggccaagaaagaatttaagcaggacaaagccctgacccaggatgagttctacaagattgtcaaagagaaccttgacgattctcaactggctcagaagatcctccagaagattgacgaaggaaaatttatgcccaagcagagagttaataaaaacggctacatcccttatcaactgcaccagattgagctggatcagatcatcgccaatcagtccaagtactatccgttcctcgcggaagagaaccccgtgaaagaacatcgcaagcaagctccttacaaactggacgagcttgtgcggtttagagtcccctattacgtggggcctctgattagccccgatgacaagcgcaaggacgagcagcagaataaaaaccacgaaatgttcaagtttgcctggatgaaacggaaggatgacaatggagccatcacaccgtggaacttcgctcagaaagttgatagagagacctccgccaatcgctttattaagcggatgaccgtgaaggacacatatctcatcggcgaagatgtcctgcctgctagatctctgctttaccaaaaattcgaggtgctcaacgagctgaataacattcgggttaatggcaagcgcctggaacccaaatttaagcagaaagtgttcaacgaactcttcaagcagaagaacaaagtcacgaagaaagcctttaaggagttcatcctgcagaataccgggatgaaaacagcggaaattgacggacttgccgatcctaccaagtttaacagctccctgagctcttactatcatctcaagtccacaaaagtgttcgacaagcaactggatgacccccagtaccaggctgattttgaaaagatcatcgagtatagctctattttcgaggacgccgaaatctaccaagagaagctgcacaaagaaattaagtggcttacccccgctcagtttaaagccatcgcgaattggagactccagggctgggggcggctgagcagaaagctgctcgtcgagctgaagggaaaaggcggggaaaacattatctatcagctttggacgacacaaaagaatttcatgcagatcgtgaacgagcctgagctgaaaaaggccattgttaaagaaaatcatcaggctaccgaggaaaagggaatcgagaagattctcgatgactcctttacctctccggccaacaaaaaggctatccgccaggtgattaaagtcgtggacgatgttgtgaaggccgccggcggcaaaaagcccgctcaattcgcgatcgaatttacacgggagcctaagtggaatccccacctgagcaacatcagagggaccaaactgcttcaggtctacgaggacacagccaagaaactcgtggatcagtccctgacggacagcctgcgcgaaaatatgaccaacagaaatctcctgaaggatgagtatttcctttactttattcagggaggccgggacgcttacacagggaaaaagatcgatattgacgatatccctaagaaatatcaaattgaccacatcctgccccagtctttcatcaccgatgactccctcgacaaccgcgtgctgacagaaattgagatcaatcagaagaaaggaaagaaatacgccagccatctgttcgccccgaagcctgcttttggccttaaccaatctatttccgagatgtggaagacctggcagaaagccgggctcatcagccagagaaagctgaacaatctcctgttcgatcccgacctggttaaagataagcagaaaaagggctttattaaccggcaacttgtcgaaacgtcccagatcattaaactggtgtctatcatcctccaggacaagttccctgataccgagattatcacagtgaaggcgggatataataccgctctgcgcaaagaactgaaactttacaaaagcagagaggccaacgactatcaccatgccattgatgcttacctgacagccatctgcgacaattttctctatcaggtctaccccaacttccggccgtttttcgtgtacggccaatttaagaaattctcccaggataccgacaagcagaagaaagcggttaagtattacgggctgaaaaattttctcctgccccttctggatgactctacgggagatgaagtgatggtcaaccacacaaagcacgtggttttccataaacagcgcgacattttcaatagactcatccaggcttataactacaagtatatgctggtgagccgggagaccacaaccgaaaattccaacatgtttaatatgaccatctacccgcgcggcgaaagagaccggaagaaaacaagaaagctgattcctaaagggaaggatcttgaccccgccatctatggaggctacagcgggaacacggatgcctacatggtcattgtgaaaatcgagaagaccaaggaaacactgtataaagttgtgggcgtccccatgcgcgctctcgcctctctgaagaaagctcaaaaggagggaaattacgaccaggaactcaacaaagtgctggagcctcttattatgttcaacaagaatggcaaatccaaggccgggatcaagggatttaccgtggtcaaagatcacgttcatttcaaacaggtggtgatcgacggcgatagcaaatttatgctgtattctgcgcaataccgggccaacgctaagcagctcacactgtcccaggagaccatgaaagtcgtgacggacaatacagatgacatggatcaaaagaacgccgacaaggatcagctgcttctgaatgcttatgacgaaattctcgagaaagttgaccagtacctgcctctcttcgatatcaacgggtttagacagggactgcacgacggccgcgccaagttcgccgctcttaaaaccagcgaaaagaaatataccctgaagaatgtgctgaacgggctccatgataatctggtcacacccaaccttaagaatattggcatcaaaaccccttttggactgatgcaatctagctccggcattacactcagccccaacgcgaagctggtgttccagtctcctacggggctctttgagaaacgggttaagctgaccaatctttga

SEQ ID NO: 4451 - RNA, 4203 nt, synthetic construct
  misc_feature 1..4203: note = Cas9 variant
  source 1..4203: mol_type = other RNA
atgggcaagcagaaattcaacgactactatctggggtttgatatcggaaccaatagcgccggctgggctgtgacagacctccaatacaagctgcttagattcaacaaaaaggatatgtgggggtcccggctgtttgacgaggcccagacgtctaaagaacgcagagtctatcggaatagccgcagacggctcgatcgcagaaagaagcggctgaaacttctggaggaactcttcctggacgagatttccaagatcgataacacctttttcaaacgcctgaaggaatctaatctctacaacgaggacaaaagcattaagtttaattatcccctgttcaacgataaggactacacagatatcgacttttataatgagtacaaaaccatttaccaccttagaaaggatctgatcttcgaagacaaaaagtttgacatccggctcgttttcattgcgctgcatcacatccttaaatatcgcggacattttattttcgagggccagtccttcgaagagatcaagtcttttgatagcattttcacacagctgtccagctactttctcgagaacttcgactttaatatcgatgtgtctattaaagaaaagctggaggaaatcatcctgtccgacaacaccaagagcattaaaaagacagagttcaaaaagatcttttctgataataaagtgctctccgtcctgaacatggctattgggagcaaggtgtctcttaaggacgttttcaataacgaggaactgaaagagcaaaagatctcctttagcgaaattgattatgagaacgaaaagagagacgagttctaccagctcctgggagaagatatctttcttatcgacctggccaagaaaatttatgatttcatggtgctcaagaagatcctgaaaaataccgactccttttctgccagcaaggtcgctctgtactgcgagcacaaaaaggacctcgatgacctgaaatatattttcaagaagtaccttacgaaagaggattacttcaagtttttccggtccaacgtggaaaagatcaattatcctagctacattggcctgaacaagatcaaatctaagaaaatcattaaggagaataagtgttccatcagcgacattaacaaagaactcaagaataaatatctgaaggatatcaaacttgaggccaaggacaaggaactgtttaaccgcattttcaataaactcgatgagtttaagttcctggagaaactgaagtctagcgaaaactccaccgttccgtaccaggtgcatgagatcgaactcaaaaagattctggacaatcagagaaagtattacccctttcttaacgagaaaatcgatggcaagtctgtctatgagaaaatcattcaactgttcgaatttaagatcccttactacattgggcccctcaatacagaccctaacgtgaaaggaaagaatacctgggtggtccggaaggatgagaacaacaaaacacccatcaccccttggaatttcgaacagaaggttgacatgcagaaaagcgctgaggaatttattaagagaatgacgaaccgctgcacatatctgaaagccgaggatgtgatcgcgaaaaattccctgctttacgaggagttcatcctcctgaacgaactgaataaagtgaccgtcgacaacgaaattctccacccgacactgaagaccgagatcattaatgaactttttaagaccacagtgaaagttacgaagaaaaagttcatcgagttcctgaaaaagaagcaggccgtgaacgacgtcgagagcattaccggcatcggggtggaatttaattgtaaactccaaggatataacacattccggaagatcctgggcaaaaagattgagaatgttaacgtgaaaaattttgtcgaaaagtgcatcgagctgaagtgtctttacgggtctgataaaaagctgttcgaaaacgctattggaaaaatctatagagagtacaatattaccgacgaggaatttaacaagatcaaccgcctcaatttcaacaaatgggcccggctgtccaagaagtttctcacagagatcagcttcgaaaagaccgatggcacgaagagatttgagtctgtgattgaggctctgcgctccacaaattataaccttatggaactgctcagcgacaaattcaatctgcagtccaagatcgatgagattaacggcgaagacgatttttctaatatcgacattaaagagtacgtcgataagctgtacgtgagcccctccgttaagcggtctatcattcagacctataaaatcgccatggaaatcaagaaaattaccaagaaagaccctaagaaaatcttcattgagatggcgaaggataagggggagaaaggaaagacaaccgagaaaagaaaggacaaaatcaagaaactttacaaaaacattaaggatacactcagcgactattgcaataacctgcaagacctgacgctccaggtggaaaaatacgatgacaatcgcctgcggcagaagaaacttttcctgtattttatgcagatgggcaagtccatgtacaccgggagatgtatcgatctcgaagacctgttcaacaataacgtctatgatatcgaccacatttacccccaaagcaaggtgaaagatgactcttttgataatatcgttctggtggagaaggaagagaaccatcgcaaatccaacgagcttctcaaggaagagattcagagccggatgaataactactggatcttcctgagagaaaataaatttatttctaaggagaagtataaccggctgacacgcaaaaaggacttcaccgatgaggaactcggagactttgtcgccagacagctggtgacaacccggcagtccacgaaagagatcgctaagttctttgagaaaatcttcgaaaagaccacagtggtttacagcaaagcctctcttgtcagcgaatttagagagaagtatgacattatcaaggtgcgcgaggtgaatgatgctcaccatgcccaagacgcctacctgaacattgtcgtgggcaatgttttcaacaccaaatttacaaagaattattggaaattcaccaaggatatcaaacggcagaacgaagagaatcctaacgaaaagaaggggtacaatctcagaaaaatttatgagtccgacgtgttctgcaacgatagcgtcgcttgggtgtactctaaggaaaatcccaaatacaacacgatcaatacagttaaggacatggtgtatcgcaaaaccgcgaacattacaagaatgctggtcgagggaaagggccagctgtttaaccttaccatcaaggataaaacccagctgaagaaaaatgtgggcaacatcgttgccaatacaccgatttccctcaagaaccggaaactgcacctcaatagcgtggagatcgctaagaagtacgggtatttcgactccctgaacaatgcctactttgtccttttcaaatatgaagagaagggaaaagaaaagattggctttgattctatcacgattgcctacaaagagcgcctgaagaaaaacctcgacatcgaaaagttcctggagaataaggggtataaaaacagcaagctgatcagaaaaatttttaagaatcaaaaagtgcttatcaacggatacccttacctgctcaagtccttcaataagcagtctcagattaaatttaacaatttcaagatcctgtatctcaacgagaacaatctgaaatttgctaaggatgccattaaattcgaaaagaacaatgcgaacgtggaccttaagaaacagaagtacatcgtcagctttctgaaaaagaaaaagcaaaatgagatcaacgaaacctatgaggaatgtattgatcggctcaatgacgagttcgacacactgttcctgaaactttgcgatatccagaaatcctctatttacaccaactataagctgcaggactttagctccaataaaaagagcatcgagattaaagataagttcgacatctttaagtctctcgatctgtacaaaaagtccaaactcattaaggagttcctgaactattacaaatacgaaaagaatgaccttgattttagcctgatcgacatcgataaaaaggctaactgtattcaaaagcacttcacagaagacctggttaaagattttgtgatcgtggacgagtctgtcaccggcctcttcgtgaagaaagagcgcctgaagtga

SEQ ID NO: 4452 - RNA, 4203 nt, synthetic construct
  misc_feature 1..4203: note = Cas9 variant
  source 1..4203: mol_type = other RNA
atgaagaccatcacagaggactacattctgggcctcgatatcgggacgaacagctgcggatgggccgtgatggacaaaaagaatagactgcttcggctgcgcggcaaaagagctattgggtcccacctcttcgaagagggacattctgccgcggatcggcgcagctttagaaccacacggcgcagactgaagcggcgcaaatggagacttcggctgctcgaagagatcttcgctgaacccatggccaaggtcgaccctgcctttttcgttcgcctgcaccagtcctgggtgtctccgctggataaggaccggaaaaagtatcatgctattgtgtttcccaccgccaaagaggatcacgagttctaccatgactatcctacaatctaccacctccgggatgctctgatgcgcgaagacagacaatttgatcttcgggagatcttcctggccattcaccatatcgtcaagtatagaggcaactttctccaggacacccccgtgaatagcttcgttgcgtccaaaattgatgtggcctcttttctgacaaacgtcaatcaggcttacgccgacaagtatggggaagaacagaacttcatcgagcttaatgaaaacaatgctgccgcgattgaggccgtgatccgcggaaaggacaaagataagaccacgaaacaactggacaaggctaaaaagattaccaaactcctgcagagctccacaaacaagtacgaaaagaatgttacccggcagatcgccaacgctatcattggctacaaaacacagtttgagaccatcctgggcaaggatattgacaaaaatgataaggccgactgggaatttaaactcagcgatggggacgccgatgacaagctggagaaccttctgcctgagttcgatgacaatgaccaatatatcgtggctgaaattaagaaactctttggatctatcgcgctgtcccagatcgtctacgagaacatgacgcttagccagtctatgaagtgtaaatataaggatcacggcgacgattaccatctgctcaaacagtatattgccacactgtccgaccacgggcaagtgagaaagctgctcctggcttacgatctttatgtgaacaatcgccacggacggctgctcgaagccaagaaagagttcaagcaggacaaagccctgacccaggatgaattttacaagatcgtcagagagaaccttgacaatagccaactggctcagaaaattctccagaagatcgaggaagagaagttcatgcccaaacagcgcgttaacaagaatggctttattccttaccaactgcatcagatcgaactggatcagatcattgccaaccagtctaaatattacccgttcctcgcggaggaaaatcccgtgaaggagcaccggaaacaagctccttataagctggacgagcttgtgagatttcgcgtcccctactatgtggggcctctgatctcccccgatgacaaacggaaggataagcagcagaacaaaaatcatgaaatgttcaagtttgcctggatgaaaagaaaggacaacaatggagccattacaccgtggaacttcgctcagaaagttgaccgcgagaccagcgccaatcggtttatcaagagaatgaccgtgaaggatacatacctcattggcgaagacgtcctgcctgctcggtccctgctttatcaaaaattcgaggtgctcaacgagctgaataacatccgcgttaacggcaagagactggaacccaaatttaagcagaaagtgttcaatgagctgttcaagcagaagaacaaagtcacgaagaaagcctttaaggagttcattctgcagaataccgggatgaaaacagcggagatcgatggacttgccgaccctaccaagtttaactctagcctgtccagctactaccacctcaagtctacaaaagtgttcgataagcaactggacgatcccgaatatcaggctgactttgagaaaatcattgagtactccagcatcttcgaagatgccgagatttatcaggaaaagctgcataaagagatcaagtggcttattcccgctcaatttaaagccatcgcgaattggcggctccagggctgggggagactgtctcgcaagctgctcgtcgaactgaagggaaaaggcggggagaacatcatttaccagctttggaccacgcagaagaatttcatgcaaatcgtgaacgagcctgaactgaaaaaggccattgttaaagagaatcaccaggctacagaagagaagggaatcgaaaagattctcgacgatagctttacctccccggccaacaaaaaggctatcagacaggtgatcaaagtcgtggacgatgttgtgaaggccgccggcggcaaaaagcccgctcagttcgcgattgagtttaccagagagcctaagtggaatccccaactgtctcacatccgcgggacaaaactgcttcaggtctatgaagacaccgccaagaaactcgtggaccagagcctgacagattccctgaaggagaacatgacgaatagaaacctcctgaaagacgaatacttcctttattttattcagtgcggacgggatgcttacaccggcaagaagatcgacattgccgatatccataaaaagtaccaaatcgaccacattctgcctcagagcttcatcacagatgactctctcgataatcgcgtgctgaccgagattgagatcaaccagaaaaagcataaaaagtatgcctcccacctgttcgctacaaagcccgcctttgggcttaaccaaagcatttctgaaatgtggaaaacctggcagaaggcgggactcatctcccagagaaaactgaataacctcctcttcgacccggatctggttaaggacaaacagaagaaaggctttattaatcggcaacttgtcgagacgagccagatcatcaagctggtgtccattatcctccaggacaagttccctgataccgaaattatcacagtgaaagctgggtacaacaccgccctgcgcaaggagctgaaactttataagtctagagaagccaatgactaccaccatgctattgatgcctatctgacagcgatcaacgacaattttctctaccaggtctatcccaacttccggcctttcttcgtgtacggccaatttaaaaagttcagccaggataccgacaagcagaaagaggctatcaagtactatggactgaaaaattttctcgagcccctgcttgatgactccacgggcgatgaagttatggtgaaccacacaaagcatgtcgtgttccacaaacagcgcgacattttcaatagactgatccaagcctacaactataagtacatgctcgtttctcgggagaccacaaccgaaaatagcaacatgtttaatatgaccatttatcctcgcggggagagagatcggaagaaaacaagaaagctgatccccaaaggaaaggacctggatccggccatttacggcgggtattccggaaacacggacgcttacatggtgatcgtcaaaatcgaaaagaccaaggagacactttacaaagtggttggcgtgcctatgcgcgccctggctagcctcaagaaagcccagaaggaggggaactatgaccaggaactgaataaagtcctcgagcccctgattatgttcaacaagaatggcaaatctaaggcgggaatcaagggctttaccgtggtgaaagatcatgtccacttcaagcaggttgtgattgacggggattccaaatttatgctttacagcgcccaatatcgggctaacgccaagcagctgacactctctcaggaaaccatgaaagtggtcacggacaatacagatgacatggatcaaaagaacgctgacaaggatcagctgctgcttaatgcctacgacgagatcctggaaaaagtggatcagtatctccccctgttcgacattaacggatttagacagggcctccacgatgggcgcgccaagttcgctgcgctgaaaacctccgagaagaaatacacccttaagaatatcctgaacggactgcatgacaatctcgttacacctaacctgaagaatattggcatcaaaaccccgtttgggcttatgcaaagctctagcggcatcacactgtcccccaacgccaagctcgtgttccagagccctacgggactgtttgagaaacgggtcaagctcaccaatctgtga

SEQ ID NO: 4453 - RNA, 4203 nt, synthetic construct
  misc_feature 1..4203: note = Cas9 variant
  source 1..4203: mol_type = other RNA
atgaagaccatcctgggcctcgacctggggacaaacagcattggatgggcccttgtgaaagagacggaaaattccaacgagaagtctgaaatcattaaactgggcgtcagagttaatcccctcaccgtggatgagaagacaaacttcgaagctgggcggcctctgagcaccaatgccgaccgcacagcgaaaagatccgctcggcgcaaccttcagagatacaagctgcggcgcaagaatctcatcgatctgctgattaaacacagactcatcgacaaggataccccgctgacagagatcgggaaaaacaccacgcatcaaacccttgagctgcgggccaaggccgctcgcgaaagaattgagctcgaagacctggcccgggtgtttcttgctatcaataaaaagcgcggctatagatctagccggaaggtcaacaatgaggaggaaggacaggtggttgatggaatggccgtggcgaaaaagctgtacgacgagaacctcacacccggccagtatgcctacgaactgctgtccaaaggcaagaaatatgtccctgatttctaccgctctgacctccaggctgagtttgatagcatttgggaatatcaaaagcagttctacgccgacatcctggatgacgagctttacaatgctctgaaagggcagggacagcaaaactccagaaagcggtttctcgccattaagggcgtgtataccgcggagaataaagggaagagagacgaagttaaactgcagcactacaagtggcgcagcgaggccatcacacagaaactttctattgaagaggtggcttatgtcctggtggaaatcaacaacgatctcaataagtccagcggatacctgggcgccatctctgaccggtccaaggagctgtatttcaacaaagagaccgtgggggaaaatctctggaagcagattcagaaaaacccccatacgagcctgaagaatcaagtcttttacagacaggattatcttgacgagttcgaacaaatctgggagacacaggctcagtttcaccctcagctgaccctcgccctgaaagaacaaattcgcgatgttgtgatcttctaccagcggaaacttaagtctcagaaaggactgctctccttttgccagttcgagagctgggagattgaaagaaaggacgagaacggcaatgtgatcctgaacaaaacaacccaactgcccaagcgccagaccgtcggccggagagtggcccctaaatcctctccgctctttcaggagttcaagatctggcagaatattaacaatctggaaatcgctaagattagcgatgggaactccaaaaataagaaagagacagaagcgcttagcgacgatgagcgcaagctcctgttcgaggaactgaacctgcggggaaatctttctcaaaaagaagttctccagatcctgggcctgaaggacaaagagtacaagacgaactttcccgaggggctcgaaggaaacagaaccaatgccgctctgttcaacatttatcagcagatcgccgagaatgaaggctacggggattggacaaagaaatccgcccaagagatcaaggaggaacttaaagctgtgtttcctcagattggaatccaggccgacattctggacttcaacgcggagctcgatggcaaggaatttgagaatcaagctagctatcagctgtggcatctgctttactctgccgaagaggacgataaaatcaacgaagaggaccagattatctatggcaatagcgccgtctccctcaagaagaaactgtgtgagaagttcgggtttacccccgaatacgctaaatggattgccaacgtgtctctgcaggatgactatggaaatctcagcacaaaggctatgcgcaaaatcatcccttacctgattgatggcaacgactactccgaggcctgcgcgcttgccgggtataatcacagcaactctctgaccaaggaagagaatgataaccgggagagactcaataagctggaactgcttcccaaaaactccctccggaacccggttgtggagaagatcctgaatcaaatggtcaacgtggtcaatcaggtgattgaaacgtacggaaaacctgacgaggttcgcatcgaactggctagagagctcaagaaaagcgccgaggaacgggctgagatgacaaagggcattaacgaagccaccagacgcaatgaggatatcaagaaactgatcaccaagaacttcgggattcccaatcctaccaaaaacgacgtggtccggtatagactttgggaggaactggcgcccctcgcctacaaggatgtgtttacaggccgccagatcaaaaaggaggacctgttctcttccaaaattgacatcgaacacattatccccaaggctctgctttttgatgacagcttctccaataagacactcgcctttagagagacgaacctgaaaaaggctgatcggaccgcctatggattcatcgaatctgactacaatgccacactggatgactatattcagcgcgttgagaccctctacaacaatgctaaaggcacaatcagcaaggggaaaagaaacaagctgcttatggcgcaaaagaatctgcctgatggattcattgaacgggacctccgcaactcccagtacatcgccaaaaaggctaaatctatgattgagaaggtgtttaacgatgtcaatgtgaccagcggctccatcacggacagactgcgggaggattgggacctgatcaacgtgatgaaagaacttaatttcccgaagtataaggccctggggctcaccgagattgaggaacgctacgatatcggacaggagaaaacaaagaaagttgaagtcattaccgactggacaaagagaaacgaccatcggcaccatgccatggatgctctgaccgtggcctttacgacaaaaagccacgtgcagtatctcaataacctgaataccatccactctcttaagggcgacgaggtcgatctggaactctccaagctgtacgggctgaaaaacacaattaccgaggtggttaataagaaacgcaagttcattccccctatgcccaactttagagaagaggcgaaaaagcatatcgagaccatccttgtgagcatcaagaataaaaacaaggtctatacaaagaatattaacaagacgaaaaaggaatctggctaccacaccaaagagcaactgacacctcggggacagctccataaggaaaccgtgtatggcaagtccaaaagacccatgaataagccgacaaaaatcaacaagaatttcagcctggagcaggctcaactcattatcaacgttcaggaaaaagagctggtgcttcgccacctggcccagtttgacaacaatcctgccgtcgctttcgataccaagacgctcaagaaaatgcccctgctgaagaacggggagcctcttaaagaagtgctgtgttttgaggaaattttcacaatccggaaggacatcacccccgatctcaaaattgagaaggttgtggacgaaaagatcaaagccattctggagcagagaaagaaagattttggaggcaatgcgaaggaggctttctctgacctcgataaaaaccctatctggctgaataaggaaaaggggatttgcatcaaacgcgtcaccatcacaggagtgagcaacgccgaggcccttcatcaccaaaaggaccacctgggccgggaaattctggacgataatgggaaccccatcccggctgactttgtgtccaccggcaataaccatcacgtcgccatttacgaggatgagaaaggaaagctccaggaaaaagttgtgagcctgtacgaggctgtggccagagcgaatcagggccttcctgtcgtggacaaggggctgaacgaagatctcggatggaaattcctgttcacaatgaagcagaatgagatgtttgttttccccaacgacgattttgacgtgaatgatatcgacctcctggatgaaaacaacgccaagattatctctcaacatcttttccgcgtccagaaactggctacgaagaattatatgtttcggcaccacctggagaccaacgtgcaggaggttaaagaactcaatgacattgcctacaagtccatcagaagcacagagcccctgaaaaacatcaagaaggtgcgcattaatcatatcggcaaaattgtccaggtgggggaatattga

SEQ ID NO: 4454 - RNA, 4209 nt, synthetic construct
  misc_feature 1..4209: note = Cas9 variant
  source 1..4209: mol_type = other RNA
atggccaagaaagactacaccatcggcctggatattgggacaaacagcgtgggatgggctatcattgacgataatctcaagctgcttaaaagaaacatgacgatcaagggcaataccgacaaaaagtccgtcaagcgggatctgtgggggtctctcctgtatagcggaaactccgacaaaacaacctctgccgcggatgctcgcagcaagagaggccttcggcgcagactgcggcgcagaaaataccggctcgaccgcctgaagcagattttctccgagatcatcaatgataaagcccccaactttttcgacaagctgaatgaatcttttctcaaccctaaggataaaaagtatgggaaataccaaattttcgacacagagaaggaagagaaagattattacagacggtatccgaccatctaccatctgcgcaaggaccttattgaaagctccaaaaagcaggacatcagactggtttacctcgccctggctcacattcttaagagccggggaaattttctgttcgagggcaacatcgatgacctcaaaaatgattttgccggcatttatgaggaagtggtggagctgtgcatgacaatcaacgctgaagacgtcgatctggagttcgaggaagtggacaagcagtctctcaattccatcattaaaaacgaggatatcagcgaaattgagcaggggctggaaaattttgccgacgagcacgttatcttcaaggagcaaaacaaaaagaagaacgatctgttttctaattgttgcaaaattatctgtggacataccgtgaaggcgaacaaattcgcctccgaacttgacagcgagctctttatctctttcaagtccgatgactacgtcgacgtgattgatgttatccagagcggcaatgaaaacattgctaatctgcttctggcctgccgcaaggcttatgactacatcatgttcaacagactcgtggatctgaatattgactcccccgccaaactgtctagcaacatggtctccctctataatcagcacgagaaggatctgaaagcgtacaagaaacttatcaaggaatttaacaaattcaagcggagcaatgggtgtaaggacctggagatgatcattctcacggccgatgacatcgattcttttcgcaaaaaggtggacaaaaaggagggaaaactgaacggcattaataagaaaatcacccatgaacaggctcttaagaagcaactgaaagatatgaagaaaattctcgaggacaagaacacagaagccgaggataaacagatcaatgacattctgaagatgatcacctccatcgaggaaagagtgaacaagagctgcttcctgaaaaacctccggtctacagacaatgctagcattcctaaccagatccagagacaagagatggaagccattctggataagcaggccaaattttatcccttccttaatgagcacaaggacgaactgctccagctgctgtcctttcgcatcccttactacgtcgggccccttgttaacaaaaagtattctcggttcgcttggctcgtgagaaaggagggacaagtgcagaaaattacccctacgaattttgatggcgtcgtggacaagcacaaaacagcggagaagttcatggaacgcctgatcggcaaagatgtttacctgccgaacgagcgggtgctccccaaggccagcctgctttatcaggaatactgtatctttaatgagctgaccaaggtcgcttatattgactccacagggaaaaagaacaatttcagctctgaagagaaactcaacatctttgagaagctgttcaaaaccaagagagaagtgaccaaaacagatctgtgcaagtgtcttaataacgtttgcaagctcaaagagaaggtgaaagaaacggagattatcggaattaaggccaaattcaatgccaagtactccacctatcatgacctgaagaaaatcaacggcatggaacagctgatcgctgatgaggaggggaagcctctctgtgaagacattatcagcattctgacaatctttgaggataaagacattcgccttgtccggctgaaggaactcctgtgccaaaataaagatctgatcaacaagttctctctttccgccgagaagctcgcgaaagtgctgagcaccaagcactacaaaggatttggcaacgtctccgctaagctgatcaatgggattagagacaaaaactgcaagacaatcctcgactacctgattgaagatgacaaggaggcctattacggacgcaataaccccaatcggaaccttatgcagctggtgaatgattctagactcgccttcaaaggccagatcgaccgggagcagaacacccatctggaagatctgagccttgacgagtttctcgatgacctgtatgtttccccttctattcgcagaggcatccggctgacgattagactcgtggatgaactggtcgagatcatggggtaccttcccaagaatatcgtgattgagatgccgcgcgaagacggagagaaaggcaagatcgctgatacacggtatagcaaactggaaaagatgctcaagaaagacgccgctctggaggacctgtacagagttcttaagacctatgagaaaaacaagaaagccctggcgaatgatgccctctacctgtacttcctccaaaacgggcgcgacatgtataccggaaaggaaattaatctgtccgagcttcacagctacgatatcgaccacattatccctaaatcttttaagtatgatgactccctggataacaaggtgctcacagctaaaaagatgaatatggacaaaagaaccggcgccctggatcataacatcattgaaaaccagtgtgggttctggcgggtcctgcttcagcaggacaagatcagcctggagaaatacacaaatctcatgaagacggaatttaccgaggctgataaggccggcttcattatgcgccaactggtggaaacaagacagatcaccaaatttgtggcgcggtatctcgacaacaagttcaatggactgatttctgatcccaacgacaaagttaatatccttctgcctcgcgcctccctctgccaccagtttagagagacattcggcttctacaaggtccgggagctgaacgacatgcatcacgctcatgatgcctatctgaatgctgtgatcgccaacacccttaataaaaacgcctacctgagcgacctcctgaagtacggggcttattctaagtacaaaaagaatggatttaacaatagcaacggcattatggattatttcgggaatacgcagtttaactgtctcttcgtggtcgaacgcaccctggacaaatgcagagtgaatatcgttaagcaccccgagacagcgtccggagaattttacaacgagaccattcagaaaaacaaggtgaatggcgggagctctacacggtcccttaagagctccgtcaaagtgctgcaaaacaccgaacagtatggcggattcacgaatgttaacaatgcctactttatcctgttcgattataaggctaaatctaagctcaaacgcaagctgattggcgtgcccatcgtcgacagacaaaaatttgagcaggatcctgtgacataccttgaggccaaggggttcgacgaaccgaagctggttcagaaactcctgaagtacaccctcctggagtatgaagatggaaaacggagataccttacaggcgtgaccgggaagcgctgtgagctggtccgggccaaccagctgctcctgcccagaaatatgatggcccttctgcaccatctccaagagtggcagaaacacgactttggaattaaggaaatgaccaaggtgatcaaaaacacaaataacatcgaggctaagttcgataaactgttcgaacatatgatgaagtttattgacaaatatagcgagcctcccaagatcgtgtcctctaagattagcgaagagtaccacaaactccgcgagtccctgtgccaggatgacaataagatcaaaatttatgcggaaatcggcaaggcccttctgtctctgctccacctggtcgacagcaaatccgcttgtgttttcaagtttagcgggcttgagatcaaccggattagataccagtctatcaatgaaaagaaagagcctgtgattatcttccaatccctgagcggcctccgcgaatctcggtataagtacaaccagtga

SEQ ID NO: 4455 - RNA, 4209 nt, synthetic construct
  misc_feature 1..4209: note = Cas9 variant
  source 1..4209: mol_type = other RNA
atgaagctgagaaacgccaaagactacagcatcggcctcgatgtggggaccggatccacaggctgggctgtcacgaccctggacggggatcttttcacatttaatcaccggcccaccctgggatctcgcctcttcgagagcgcctccacagcgcaggaaaccagagaggctcggggcgcccgcagacggctgaagcgcagacggtggcgcatttctcttctgcaagaacagtttgccgctgagatggaaagctgcgactccaacttctttatcagactcaatcagtctcggctgtggcaggaggatcgcacagagcaagggaaaggatatctgttcggcggcaagcctattctctgtggggcccagatctttgctaacgaacaggagtactatcagcaattcccgaccatttttcatctgagaaaattccttgttgaatgcagcgaacaggtggacctgcggctcatctacctggcccttcacaatatcgtgaagtatcgcggaaactttctgtaccaggataataagacgctcaacgtcagaaatttcaacctggactcccagattgcggattttctggaccaactccagctgtggtgtgagaataacgatctttgcttccatgaaatcgacggcaccacaaccctggccagccagctcaatacatgtttccaccaacagtctaaccagcagaaaaaggataccctgaaaacgtttttcgctacatgcattgagaatgacaagatcgccggggaacttaccaaagctctgctcggatataagacagactttaagattatcttcaacattgagggcgaaaaagatgagtacaaggccaaatgtaacgaggaagagaagatcctgaaactgcaagaaaccatcgacgatgcgaatcaggtgctcctgcagtccattcttaacctgtacagcgggatcattgttgagaagatcctcaataacaccgccgtgaaaaatgaatctgctcagtgcacactgtccgcctatcattgttacagctatgctctttactctaagcaactgcggacgctcaagaaactggtcagaaagtataacccccagcgctacaatgagtgctttaacctgtccgccgaggaccctaaagccaagaaacagctctgtacctatgctcggtacaatgcgcagcacagcacagattacgacgagttcaagaagtatattaaagatctgtttgagaacaccgacgccgtgaatgatgctgcctaccaacagatgaagcaggacttcgatgaagagaaatttcttagacgccagaagacatccgacaacggagtttatccctaccaattccacctggaagagatgcagctcatcatcgagaatcaggcccaacattatccttttctgaccaaaattaagcccaagctggaatctcttgtgacgttccggatcccttactatgtcggcccgctcacacagaaaggcattcagagaaacgggcgcaagtttgcttggagcaaacggaataaggacgccgagaaccagagaatctacccctggaactgggattccattatcgacaaaagcgcgtctgctgaagccttcatcctgcgcatgaccggaaagtgcacctacctgtatggcgaggatgtgctccctaaggagtccctgctttaccaagagttctgcgtgctgaatgaactcaacggggcccggtggaattgtgacggagaaagacgcatgcccctgagcaacaaagattgcaaggctatttatcggcagctgtttcttaaaaagcagaaagtctcttacgccgacgttagcaattatctcaaggctcagggccacatcaacaattccgtggccgggggacaaggcgagcatggcttcgaatctacactgagctcccaccactttttcagaaaactgtttaacgtggatgcggccaatgacctcaccgctcagcagattgagacagccgagcagctgatcctttgggggacgattttcgaagataaggagatctttgaacaaaagattaaagagcggttcggagacatgtttagcaaggatgaaatcaaaaccatcgctcgcagaaagttctctggctgggggaaatgttccaagcagctgctcagcggactgacagtcgagacccctcggggcagagagtctattatcgacgtgctgcgcaacgggcatcccgaaaatggccggacacttgtttttatgcaagtgattaccgataagaaactcgagttcgacaagaaaatcgaagagtacaacaatgaacacctggccaagacgaacgagtccgtcctggacaccgcgattatgagcccggccatcaaaagaggagtgaatcaggctctccatatcgttggcgagattcgcagaatcacaaagcacgatcctacctgcatttatatcgaaacaacccgggacgagaaggatgggaaacataacacgcgcacatcctctagatacagctccctgaagaaaaaccttgaaaccctgaagtctattgacaaagccaatgctcccgccatcaagcacagcctcgagctgctggagacatacaagaaacagaacatcgatgacaaactttttctctatttcacccagaatggaaagtgtatgtactccggcaagagcctggatattaacaatctgtcttcctatcagatcgaccacgtgattcctcaaagctacatcaccgataactctttcgacaatcgggtcctcgtgtatgcctccgaaaaccagcgcaaaagcgattctctgcttctgagctccgtcattcaggctaagcaggagcccttttggacaagcctcgaaaaagcggggctgatctctgagaagaagcataataacctgaaaagaaagtcccttagcgacgcccaaatcaaaggattcattaatcggcagctggtggaaacgtcccagatcgttaaggtgctccgcgatgagctgtctcggattctccccgacaccaaaatcattcctgtcaaggctagcctgtcccacgacgtgcggatcgcctgcaacctttacaagtctcgcacagccaatagctttcatcacgctcacgatgccctgctcgcgtccaccatgggcagattcgttcagacacggtttccggacatgtatgagaaccccgtgagatacgtcaaaattctgcgcgcttacatcgcccaatctaagctgcagcatagcgcccagacccggaatttcgattcccgcagctttatggctcactctttcttttgtgactattccaacgaaaacggggatacgatctggaatagcgcctctgagattgaaagacttcggagagcgctgtcctacaaaaacctctatctgacacgccggcctttcatcgacgctggccagttttgggatcaaaccatttacagcccccatgacaagaaaaagacccctgattctctcatccccctgaagaaaaatcttgacacacagaagtatggaggctactccgggaaagattatgcccacttcttcatttacagcgtgctgaacaagcagggagacgtggagtacagatttgacggcgttccgctctatatcgccgctaatatcaaccgcgatgacagaggggccctggctcaatacgccaaacagctggtcgaacatgagaatgtgcctaacgcgaagagaaagaccaaagatcttgtgttccagcggattgagcgcgcctgcgtccccaagtatcagctgatctgtatttcccaatgcagcggagactctgatagaagcgtgtccgactactattacatcacaggcaaaaaggaagttcggaatgctctccagctggcctttcctatgcacctctatggggctattaacgccatcgaggataaaaaggaactggacgattctgcccttgaggaactggtggtctacatcctgcgcaatgctcccagaattgcgcctgacgtgttccggagactcaacctgacggagaaacttgccgattgtctggacatccccgatcgcattgagctccagaatagcatctacggcctgtttaacctcattaatgctgaatccaacgttgtgaatctgcagatcttcggaggcgccaagaccgccggggtcaaacttattaacctgaactctctgctcaatgacccggctacaaccgtgacatttatcgaccaaagcgttaccggaatgttcgagcggaaggaaacgatcggcatttcctga

SEQ ID NO: 4456 - RNA, 4209 nt, synthetic construct
  misc_feature 1..4209: note = Cas9 variant
  source 1..4209: mol_type = other RNA
atgggcaagcaggagttcaacgactactatctggggtttgatatcggaaccaatagcgtgggctgggccgtcacagaccaacagtacaaactcctgagattcaacaagaaagatatgtgggggtcccggctttttgaagaggctaagacggccaaagaacgcagagtttatcgcaattctcggagacggctggaccgcagaaagcggcgcctcaagctgcttgaggaactgttcctcgatgagattctgaaagtggacagcacctttttcaagagactggaggaatccaacctctacaatgaggataaatctatcaagtttaactatcccctgttcaatgacaaagattacacagacattgatttttataaggaatacaagaccatctaccaccttcggaaagcgctggtgttcgaggaccgcaagtttgatattagactcctgttcatcgcccttcatcacatcctgaaatatcggggacattttattttcgagggccagagcttcgaagacatcaagtcctttgactacattttcacagagatccaggattggattctcgaaaactttgagatcaatattgacatcaacctgaaagaaaagctggaggagatcattctctctaataacaccaaaagcatcaagaagattgagttcaaaaagatcttttccgataatcgcattctggctatccttaacatgggggtcggatgcaaagtggacctgaaggatgttttcaataacgaggaactcaaagaccaaaagatcagctttacagagattgattatgaaaacgagaagagagacgagttctaccagctgcttggcgaaggcatctttattgtggatctggccaaaaagatctatgacttcatggtcctcaaaaagattctgaaaaattctgattacttttccgagagcaaggtggctctgtatgaggaacacaaggaagacctcaaccggctgaaatacatcttcaagaaataccttaagtcttccgactattacaaatttttcagaagcaattctgagaagaccaactatccttcctacatcgggctgaataagattaaaacgaagcgcctcatcgagaacaataaatgtagcatttccgatatcaacaaggaactgaaaaataagtatcttaaagacattcaggttgaggccgaagatgaggagctgttcaaccggatcctccataagattaatgaaaacaagtttctggagaaactgaagtctagcgaaaattccaccgtgccgtaccaggtccacgagatcgaactcaaaaagatcctggacaaccaaagaaaatatcacagcttccttaatgagaagtctgatggaatgacactgtgcgagaagattatcaaactctttgagttccgcattccctactacgtgggccctctgaacaccaaccccaatatgaacaagaaaaataagaacacatgggtggtcaaaaaggaagaaaattccaagagctctatcaccccttggaactttgagaaaaaggttgacgaacagaaaagcgctgaggagttcattaagcggatgacgaatagatgtacatatctgcgcggggaagatgtgatccccaaaaactcccttctctacgaggaatttgtgctgctgaatgagctcaacaaggtcaccgtggacaatgaactgcttcatcctacactgaagaacgagatcattgatgaactcttcaaaaccaccgttaaggtgacaaagaagaaaatcacggaatttctgaagaaaaagcaggccatttctgacgtcgagagcatcaccggaattgatgtggagttcaatggcaagctgcaggggtataacacatttcggaaaatccttggagaaaagatcgagaatctcaacattaaaaagttcgttgaaagatgcatcgagctgaaatgtctgtacggctccgacaagaagctctttaaaaacgcggtgggcaagctgtataaagaatacaatgtcaccgatgaggagttcacaaagattaacaaacttaatttcaacaagtgggggcgcctgagcaaggaatttctcaccggaatccggttcgagaaaacggacggcacagaaagatttgagtctgtgattgccgctctgcgctccaccaattataacctgatggaacttctcagcgacaagttcaatctgcaatctaaaatcgatgagatcaacggggaagacgatttttccaatattgacatcaaggagtacgtcaacgagctgtacgtgagcccgtccgttaaacggtctattatccagacctataagattgccatggaaatcaagaaaattacaggaaagaatcccaaaaaggtgttcatcgagatggctaaaggcgggggagaaaagggcaagagaaccgagcggcgcaaagataagatcaaagaactctacaagaacatgaaagacagcctgtccgattattgcaataaccttcaggacctgtctagccaagtcgagaagtacgatgacaatagactccggcagaaaaagctgtttctgtatttcatgcagatgggcaagtccatgtacacagggaacgatattgaccttagcgagctctttaacaataacatctatgatattgaccacatctaccctcagtctaaagtgaaggacgattccttcgacaatattgttctggtggaaaaacaagagaaccatagcaagtctaatgaactgctcaaacccgagatccagtccaagatgaacaattactggatctttctgagagagaacaagttcattagcaaagaaaagtataatcgccttacgcggaaaaagaacttcaccgatgaggaactgggagactttgtcgccagacagctcgtgacaacccgccagtctacaaaagaggtggcgaagctgttcgaaaagatctttgatggcaccgaggttgtctacagcaaagcctccctggtgagcgacttcagagagcggtttgatattatcaaggtgcgcgaagtcaatgacgctcaccacgcccaagatgcttatcttaacattgtggttgggaatgtgttcaacacgaaatttaccaagaattactggaaattcatcaaggagaacaatagaaagaacgaagagaaccctaataaaaaggaaggatataactttaaaaatatctacgagtctgacgtcttccggaacgaggatgtggcctgggtgttttccaaggaaaataaagagattaacacaatcaagaccgttaataaaatggtctatcgcaagacagtgaacattaccgaaatgctggttgagggcaaggggcaactcttcaatctgacgatcaaagacagaacacagctcaagaaaaaggtgggcaacattgtcgccaatatccccaaaagcctgaagaaccggaataccaaacttaaatccgacgaactggctaagaaatacggatactttgattctctcaacaatagctatttcgtgctgttcaagtacgtggagaaagagaaggaaaagattggctttgacgggatcacaatcgtcgataaagagaagctgaaaaagaactccgacattgaacgcttccttgagaacaaaggaaataagaacgcgaagctgatcagaaaaatttttaagaatcagaaagttctcatcgatggctatccgtacctgctcaagtcttgtaacaaagacaaggccattcggttcgataattttaaaagcctgtatcttgacgagaacgatctgaagttcacccgcgacgctatcaagtttgaaaagaataacgccgatatcgacctcaagaaacagaagtacattatctccttcctgaaaaagaagaaacagaatgagattaacgaaacctatgaggaatgcatcgagagactgaataacgagtttgatacacttttcctgaatctctgtgacattcagaagtctcctatctacaaaaactacaagctgcccgactttatcagcaaaaagaatgtggtggaagtcaaggataaattcgaggtgtttaagaacctcgaactgtataacaaatccaaacttattaaaaatttcctgaactacttcaagtatgacaataacaagctggatctcatcgccattgggatcgacagcaaagctaattgcattcagaagcattttacggaggatctgatcaaagacttcgttattgtggatgaatctgtcaccggactttttgccaagaaagagcggctggagtga

SEQ ID NO: 4457 - RNA, 4209 nt, synthetic construct
  misc_feature 1..4209: note = Cas9 variant
  source 1..4209: mol_type = other RNA
atgacctacagaaactatcacatcggcctggacattgggacaagctccgtgggattcgccgtccggtacgataatggcgagctcgttcataagaaagggtctaacctggtgggagctcgcctttttaaggaaggcgagacggccgaagagagacggctgaatcgcggggcgagacggcgctataacagacggaaatggcgcctcaatctgcttaaccagatcttcaagcccctgattgaagtgaatgaccctacctttttcaaaagactcgagcaaagcaacctggtcaattacgataagtccgagtcttttagcctgctcaacaatcagtccgacgataagctgcaccagcagttcccgacaatctatcatcttcgggactacctgatgaaatctaccgaaaaggctgatattcgcctcatctatctggccgtgcaccatatcgttaaatacagaggaaactttcttgacgccagccccgtggattccttcgaggctagcaatctgaaggtcgacgaaattctcacacaaatcaacctgctgctcgataatctgaccgacgatcttcggctgaacacacagtacgtgaccgacattgagcagacgctcctgtctaacaccgagtccaataaagacaaggaaaaggttatccagaaacttctgctccacaaggaggccattaaaatcgataaggaccgcacagctcaaattgccaaactggtgctgggctataaggcggatatcgccaaactctttggcatcaccgaaaagctgcagacacctaaacttgagctgagcgctgccaactctgacgatgctctcatggaactgtccgccgagcttaatgaggaccagattgggatcctgctccagctgaagaccctgtacagcagagtccggctcaaccaaattatcccctctggaacgtccctgagcaagtccatgattgaaaaatatgagcttcaccatacacagctgaagtctttcaaagaaaatatcctcctgaagctgagacgcaacaccgcggtgcggagaaatcttgagctcgcctacgctctgtatgtgggcaacgcccagacaaagcaagaagtctttgagcctaaaaaggctcgcttcaccagcgatgactttgcctccctgaaagccaatgctaagagcgcgtcttccgttaaagaggcccccaagaacaccaagacaaaactcacgaccgatgacttctacaatatcctgacagaacttttcgctacctttgagagcgaactgtctgccgatgaggacatgattaaggaagtggagcagatcaaaaaggccattacaggggacaactatctccctaaacagcggaccgatcagaatggaaacatcccgcaccaactgcatcagattgagctgagacagatccttcagaatcaactcccccactaccctgaaatggacaagatcaacgagcagaagcccattgaaaaactggtgacgttccgcgtcccttactatatcggccccctgattacaccggaggatcagcagaagtcctccgctgccaactttgcgtggatgaaacggaaggagcaaggggctatcaccccttggaatttcgacgataaagtggacagaatgcagtctgccaccaactttattaagcgcatgacagttaaagatacctacctcatcaatgaagacgtgctgcccgatcggagccttctgtatcagagattcaaggtcctcaacgagctgaatctggtgaaggttaacaatcagcttctctccattggagaaaaacaagccatctaccacgacctgtttgagaagcagaaaacagtgagcacgaagaaactgcagtcttatctccaatccgaacagggctacggcgataacatcgagattagcgggctgtctaatcctgacaagttcaacaatggacttaccacatatatcgattttaagaacattttcggcgacctggtcgaggacaccacaaaacagaaggaatttgagcagatcattgaatggtccaccgtgttcgaggatcgcgctatctttaaagccaagctccaagaagtcaattggctgacggaggagcagatcaaagctctggtggccaagcggtacagcgggtggggaagactttcctaccggctcctggcggaactggttaacgacaatggcgagcgcattatcgatattctctggaacaacaaggggtctaatctgatgagcatcgtgtcccaggacgagttccagcaacagattgccagaatcaactctcatgaagtccaggaacttggaatggagagcgtgctggctaatgcctataccagcccccagaacaaaaaggctatccggcaagttatgaaagtggtcgatgacattcagctcgccatgaatggccaggcgcccacaagcatctctattgagttcaccagaaagcctgaagagaactccgaaatcagcaaatctcgctacgagacaattacctccatctatcaaagcctgtctaaggatatcgagaaggaagtgaaagacaatctgaacaagaataaaagctcccttaagaaaaacctgagcgataagtactatctctactttacgcagctgggccgggacatttatacaaatcagccgatccccttcaacgagattccttactacgatatcgaccacattgtgcccagatctgttgaaatgaatgattccctcaacaatcgcgtcctggtggccaaaagcatcaaccagattaagaagaacaatgctcctatcgactcctctcttaaaatcaccagcgagacaagacaactgtggaagaaactcctggactccgggctgattaccaagcagaaatattacaaactttctagctccatcaagaacaccgtgtctccctatgtcaagcagggatttattaatcggcagctggtggaaacaagccaagttatcaagctcgtggccaacattctgggcacgaaataccagaatgatgacaccgagatcatcgaggtcaaggctcatctcaactccgaaattcgcaaaacattcgagttttataagctgagagaacttaatgattaccaccatgggttcgacgcctatctgaccacactcgtgggaggctacctgtacaaccggtatccgaagctgcgcagctactttgtttatggggatcacaaaagacttgacaaggcccagctgtctgagctcaaaaatttcaactttctgcacggcctcaccaatcctaagtccggaagcgatggcctgatcacggcttctgggtcccagcaagtggtccttgaccggaacgaaacaattaaacgcctgaataagatctacagatataagtacatgctgattagccgggaggtgttcaccaaacagggacagttttataacgagaccatctaccccgcgaagcctaatacagccaaaatgatccccctcaaggataacaaaccttctgaagtttacggcgggtattccagctccaatgtgagcaagattgctctgatcaaggagaaaaacaccgacaactaccagttcattggaatccccattcgctctatcgccaaacttaagcaagccaaggctaatagcaaaacagtctatcagacggaactgaacagagtgattaagtccgtgctcgcctctcagaaaaccaagaagcaaaaagagtttgaagtcatcctggataatgttaagtacaaccaggtggtggtcgaccagggcgagaaatattacctcgggagcccgtattacaagaaaaatgcgaagcagctggtgatctcccctgagtctgttaagattcttgctgacaaagccacagccgatctgcccgaacaagaggctcataacaagctgatgaccgtgtaccaggaaatcgtcgacgtgctcaataaacacttcgccctgtatgatattaacaatgttcggaagaaacttaacgacggcctgatcaagttcagccagctccccaattacgatgagacatccaagaacagatttgacatttctaaaagcatcaagaccaaatatgcggtgatcatgcgcattctgtccggaatcaagaatcagacgagcgaggtccctgaactcggcctgaaatctccgcttaacaagatgcaaaccaaagggggaattaagatctcccccgaggctaagatttactatagctctcctacaggcatcttctcccattttaaacaggtgaagaatctgtga

SEQ ID NO: 4458 - RNA, 4209 nt, synthetic construct
  misc_feature 1..4209: note = Cas9 variant
  source 1..4209: mol_type = other RNA
atggagagaatcctgggcctcgacctgggggtgagctccattggatgggcccttgtcgaagaggatgttaagaaccccgaaaataacaaaatcattaagctgggcgtgcgggtgaatcctctcaccatcgacgagaaaacaaacttcgaaaaggggaaatctattacgaccaatgctggacgcacaagcgccagatccgcgcggcgcaacctgcagagatttaaacttcggcgcaagaaactgctcgagatcctgatccactacaagattatcaaaaatgatgctgtcctggccgagaccggcaagaacacaaccttccaaacacagtatctcagagccaaagctgcccgggaaaagattgagctggacgaacttgctcgcgtgctgctcctgatcaataagaaaagagggtacaagtctagccggaaagttcagaacgatgacgatggaaaggccattgacggcctttccgtggcgaaagagctgtatgagaagaattacaccccgggccagtatgcctacgatctcctgaaacgcgggaagaagcaaatccccgacttttatagatctgatctgcagaacgaactcgaccggatttgggagttccagaaacagtaccatcctgatatcctgacggacgaatttaagaaagagcttgaaggaaagggccaacgcgctaccgccgctatcttcctgaatagatacaaaatttatacagccgacaacaaggggacccgggaggagaagaaaatccaggcgtaccagtggagagtcgaagccctcagccagcccctggatgtgaaggaggttgcttatgtgattgccgaaatcaataacaaccttaataactccagcggatacctgggcgctatttctgaccgctccaaaaagctctattttaatgggcaaacaatcggagagtacctgttcgaggagctgagcgccaaccctcacacccggctcaaaaatcaggtcttttatagacaggattaccaagacgagttcgaaaagatctggaagattcagacgaaatttcatcccgagctgacaaaggaacttaaagaacaggtgcgcgatatcgtgattttctaccagcggaagctgaaatctcaaaagggcctcatctccttttgcgagttcgaaagcagagagattgaaatcgaggaaaacggcaagcgcaaacggaagaaagtcgggctgaaggttgcccctaaatcttccccgcttttccaggagtttaagatctggcaagtgctgaataacattgagatcaaaaatgaagacgagagacgctatctcgaacccgaggaaaaggagctgctgttcaacgagctcaattgtaagggaaacctgaccagccagaaatgccttgaactgctcggctttaagtccaaagatgctaagctgaatttcaaagtggtcgaggggaaccggacaaatgaaaagctgtacgacgcgtttcttaagattctcgagctgcagggatataacgtgttcgaactgctcaaaatcaaggaggataaagacgaggccaagctgtctgaacttaaagctagcgccgatgagattaagggcatgatcaaggaaatttttaacgccaatctgatcaacacctccatcctcgacttcaatgctgagctggaagggaaagactttgagaaccaggccagctaccagttctggcacctgatgtattcttacgagggagataattcccctagcggcaacgaaaaactttatgagctcctggaaaagaagtttggcttcaaaaaggagcattctaagattctgagcaccatcgtgttttcccaggagtacgggtctctcagcacaaaagcgatgagacgcatttacccctatatcaaggacaataaatactccgaggcttgtctgcttgccggatataaccacagcaagcactctctgacgaaagaagaactcgagaatcggaagctgaaagaacaactggaggttcttcctaagaactccctcagaaatcccgtcgtggagaagattctgaaccagatgatcaatctggttaacgccaccatcagcgaatacggcaaactcgatggggtgcggattgagctggctcgcgaacttaagaaatctgcccaggagagagaagacatggctaagtccatcaatgaggccacactgctccatcagaaatatgcgaccattctgaagcaagagttcggagtcgtgaacccgagccggaacgatatcattagatacaagctgtatatggaacttacagtcaatggctacaaagacctctacaccaacacgaagatcgagaaagaaaatctgttcacagataagtatgacatcgatcacattatccctcagtcccgctttttcgacgattcttttagcaacaaagtgctggttccccggcagtccaatctcgacaaggggaacctgaccgcctacgatttcatgtctaataagggcagcgagagagaggaacattttcttaacgtgattaaagagctgctcgacaagggatccatcagcaaagctaagtatgaaaaactgaagaagaaaggcctggagattggggacggattcatcgaacgcgatcttagagacacccaatacatcgccaagaaagctaaggagattctgtttgagatcacaaattctgtcgtgaccacatccggccggattacggataaactccgcaaggactgggatctggttaacatcatgaaggaactcaatctggacaactatagacggcttgggctgaccgagattgtgcgcaatagcaaaggagaagagaaggaactcatccctgattggacaaaaagaaacgaccaccggcaccatgccatggatgcgctgaccgtcgccttcacaacccgcaatcacattcagtacctgaactatcttaacgctagaaaggacgagaaacataaggagcaccagaatatctacgccatcgaaaacattatcacggaggtgattgaaaagaagaatggctctaagacccggcgctttaaagctcccatgaactccttcagacatgaggccaagcagcacctgaaagaaatcctcgtgagccacaagaccaaaaataaggttgtcacatctaacattaataagaccaaaaagaaagggggcatccataagaaaacagagctgacgccccggggacaactccacaaggagacagtgtacggcagcaagaaatttctgcagtccagagaagagaaggtgagcgccaaattcgattatgaaaccatccttatggtcgtgaaccctattcatcgcaatgctctgctcaaccggctgaaggagtacgggaatgacccgaaaaaggcgttttctggaaagaacgccatcaataaaaaccccgtttatctggatgactccaagacagacattcttagcgaaaaagtgaccctgtcctggtacgagaccggctatacaatcagaaagtctgtcacgcctgataatttcaaagactacaagaacctcgagaaaattaccgatctggggatcaagaagatcctcaaagaacgcctggaccagttcaagggaaatgctaaagaggcctttagcaaccttgataaggaccccatttggctgaacgaagagaaaggcatcgccattaagacagtgaccatcacaggggtttccaatgctgagtctctgcacttcaagaaagatcacctcggcaaggaaattctggacgagaacggaaataaaatccctggcgattttgtgagcaccgggaacaatcatcaccttgccatttatctggacgaagaggaaaagctcgatgacaaaatggtcacgttctacgaggcggtgctgcgggttaaccagggactccccgtgatcgacaaggattacaataaggagaaaggctataagtttctgatgacacttaaacaaaacgaaatgttcgtctttccgaatgaggacttcgatcctaacgaaatcgacctgctggatgagagaaatctcgaacgcatttccaagcatctgtttcgggtgcagaaaatctctaaggtggggtacggaaacagcttcgtcagagactttgttttccgccaccatcttgagaccaccgtggaggaacggaaggagctgagaaatattacatatatccagctcaaatccctggaaggcctccggaacattatcaaggtgcgcctgaatcaccttgggaaaatcgtccagattggcgagtactga

SEQ ID NO: 4459 - RNA, 4215 nt, synthetic construct
  misc_feature 1..4215: note = Cas9 variant
  source 1..4215: mol_type = other RNA
atgaccaagaacatcctgggcctcgacctgggggtgagctccattggatgggcccttgtccaggaggattctaaaaatcccgaaaacaatagaatcgttaagctgggcgtgcgggtgaaccctctcacagtcgacgagcaaattaatttcgaaaaagggaagccgatcacgaccaacgctagccgcacactggccagatccgcgcggcgcaatcttcagagatttaaattccggcgcgctaacctgattgatgtgctcaagaagtgcaatatcctgaaacagggagacctgctcaccgagatcggcaagaactctacatttcagacccaagaactgagagccaaaagcgccaaggagaaagttgagctttccgatttcgtgcgggtcctgctcctgatgaataagaagcgcgggtacagatctagccggaaagctaagaacgaagacgagggacagattatcgatggcatgtccgtggccaaaaagctgtatgaagagaatcttacacccggcgagtacagctatcagctcctgattgaaaacaaaaagcagctgcctgacttttaccgctctgatctccaatccgagttcgacagagtttggaaatttcagaagcagttcaatcccgaaatcctgaccgatgacctttataaggagctgcaggggaaaaacaagaacgctacgtgggccgtgctcaaagaaccttttagcctggtcggaattaagcaaatcggcaccattcaggagaaaaaggcggagaagtacttctggcggtctgaagccgtgaaacgccagcttgattttgagtccctggctgtggtcttccaagaaatcaatagcaacctcaataactcttccgggtatctgggagccatcagcgacagatccaaggagctgtactttaataaccagacagttggcgaatacctcttccagcagctgaaagaaaattctcacaccaaacttaaaaaccaagtgttctatcggcaggactacctggatgagtttgaaaagatttgggagacacagagcaagtattacaaagaactcaccaaggagctgaaagaagagatcagagacattatcattttctatcagcgcaaacttaaatcccaaaaggggctgatcagcatctgtgagtttgaaaatcgggagattgaaatcacggagaacggaaagattaaaaagaaaacagtgggcctcaaggtcgctcccaaatcttcccctctgttccaggagtttaagatctggcaagtgctgaataacctcgttttccagagcattgaatctaaagagctgtttccgcttgatctggacatcaaggaaagcatcttcaatgaggtgaacattaagggcaatctctccgccaaaaacgtcctggatctgatggggtactctggaaaggaatggaaaaccaactttaagaatatcgagggcaacagaacaaatgagaacctttataccgcgttcctcaaaattatcgccagcgaagggattgagtttcccaaggagttcaagctgtccatcgacgatgacattaaagtgagcaagatcgatatctcttccgagaaaattaaggaatttatcaaagagaatttcctgaagctcggaattaacaccagcatcctggacttcaatcctgagcttgatggcaaggactttgaaaaacaggagtcttaccagctgtggcatctcctgtactcctatgaaggggacgatagcgcttccggaaacgttaagctgtacgagcttctcgaaaagaagttcggctttaaaaaggagcactctaagattctggccgacgtgggcttcagccccgattatgggtccctgtctagcaaagctatgcgcaagatctacccttatatcaaagagaataagtactccgacgcctgccatctcgccggatataaccacagcaaaaattcttttacaaaggatcagctggctaaccggattcttaaagaacagctggagatcctccccaagaatgcgctgagaaacccggtcgtggaaaagattctgaatcaaatgatcaaccttgtcaacgaggtgattaaagcctacggcaagcctgacgagatccgcatcgaactcgctcgggagctgaaaaagaatgccgaagagagagccaacatgacgtccgatattagcaaagctaccctgctccatcagaagtacgccgaagttctgcagaaggagttcgggatcaaagcgccctctcgcaatgacattatccggtataaactttacctggagctcgaaaagaacctgtttaaggatctgtatacagacgtgcaaattaagagagaggaacttttcaccgataagtacgacatcgatcacatcattcctcagtcccgctttttcgacgacagcttttctaataaggtcctcgtgccccggggagctaacctgaaaaagggcaatttcacagccctggattatatggagatcgaagggaaagagaagctcgagaaatttctgaacattatcaaggaacttttcgacaagggcgccattagcaaagctaagttcgagaaactgcagaagaaaggatccgaaatcggcgaggggtttattgaaagagatctccgggacacccagtacatcgccaagaaggctaaagagatcctgttcggaattacgaatagcgttatctctacatccggccgcattaccgataagctgagagaggactggaaccttgtgaataccatgaaagaactgaacctcgagaagtatcggaaactggggctcacagaactgatcgtcaatagcaagggagaggagaaagaaagaattatcgattggaccaagcgcaacgaccaccggcatcacgccatggatgcgcttacagtggcctttacgacccataatcacatccaatacctgaactacctcaacgctagaaaggacgagaaacacaaggaacatcagaatattttcgccatcgagaacacaattaccgaaatcgtggagaaaaagaatggctccaaagagcgcagatttaagctgcccattaagaacttccggacagaagctaaaaagcagctggaggaagttcttatctctcacaaagccaagaataaagtcgtgaccaagaacatcaataagattaaaaagaaagggagcatcattgcgaagacggagctgacccctcgcggccagctccataaagaaacaatctatggatcctctaagtttctgaagaccaaagaggagaagattagcggcaaattcgatctcgaaatgatccaaaaggtgcagaacgagaaatacagaaatgccctgcttaagcggctgcaggaatttgggggagactccaaaaaggctttcacaggcaagaacgtcatttctaaaaatccgatctttctcaacgccgagaagaccgaacagctgcccgagacggtgacactggcttggtatgagaccgggtacacaatccgcaaagttgtgaatcctgataacttcaaggacttcaaaaatattgaaaaggtcatcgacaagggagtgagagatattcttaccgagcggctgaaagaatttaacggcaatagcaaggaggccttctccaacctcgagaaaaaccccatctggctgaataagagcaaagggatttctatcaagaccgttacaatcacgggcattaacaatgccgaagctctccactataagaaagaccatctgggaaaggagatccttgatgaaaacggccaacgcattgcggtggactttgtctccaccgggaataaccaccacgtggccatctacgaggatgacaatggaaacctgcaggaaaaagttgtgagcttctatgaggctgtcgagagagtgaatcagaacctgcctattatcaataaggaatacaactttgagctcggctggaaattcctgtttacaatgaagcaaaatgaaatgttcctttttccctctgatgacttcgatccgaaggaggtggacctgtttgatgacaaatacctctccctgatcagcaagaacctcttccgggtccagtctatttccatcgttcagtatgggaatagcgtgattcgcgactttaaattcagacatcacctggaaacctccgtgagcgatgagaagaaacttcagggagtcacataccaacagatcaagtctctgcagcctctgaaagacattatcaagattcggctcaacaacctgggcaagatcgtgcagatcggggagtattga

SEQ ID NO: 4460 - RNA, 4215 nt, synthetic construct
  misc_feature 1..4215: note = Cas9 variant
  source 1..4215: mol_type = other RNA
atgaagggcaacatcgagaaaaagaaacaggagttcaatgactactatctggggtttgatattggaaccaacagcgtgggctgggccgtctccgacctctcttacaatctgcttagattcaacaagaaagatatgtggggagctcggctgtttgacgaagccaagacagcgaaggatcgcagagttaaacggaatagccgcagacggctcgaacgcagatccaagcggctgaaatatcttgaggaaatcttcgagacggagatttgcaagatcgacaaaaactttttccgcagactggaagagtctaccctccacaatgaagataagacatttgacttccggtttcccattttcaacgatgagaattacaccgacaaggagtattacaaagattttcctacagtgtatcatctgcgcaacgaactgatcaagaatgagaacaaaaagttcgacatcagactcatttacctggctatccacaatattcttaaataccgggggcattttatcttcgaaggccaagatttcgacagcgtgaccgactttaaggaggtcttctccgaactgtctgcctatctcagcgagaacctggaggaaaatcttgatattaacctgtgtgacaacatcaaagatattatctgctccaaggagaataagacaagcaaagggaagtcttttgtgtccctcatcgacagcaaagttattcagtctgtgctgcgctgttgcatcggatacagagtcaagttcaaagatatttttatcaactatgaagagaaggaaaagaatgagggcattaacctgtccgagatcgaatacgacgagaaacgggatgaaatcgccctcagcctgggcgagaatattcttctgatcgacatttgtaagaaagtgtatgatttcatgatcctcaacaatattctgaaggggaacaaatacatctctgaatccaaggttaatctttatgacgagcacaagtgcgatctgtgtaacctcaaatacatctttaagaaatacctgccgaagaaagactatttcgagtttttcagaaatgaaaacaaggagaagaattacgtgagctatatttcctctagcctgaacaatggaaagaagaaaaatacctgcacgcaggaagacctcaacaaggagatcaaagagtacattgctaagatcaaagaatatgaggaaaacgatgccgtcctggagaagattaaccttaagctgaatgaaaacaaactcctgcccaagctgaaaaccaatgacaacggcgtgatcccttaccagattcataagatcgagcttgagaaaatcctccaaaatcagtccaagtattacgattttctgctggaaaagattgacgggatcacaaacattgagcgcatcgaaaaactcttcacctttcggattccctactatatcggaacactgaagggcaaattcagctgggctaagctgaaagagaataagaagatcaccccttggaacttcgaaaagattgtggatatggaggagtctgccaaggcgtttatcgaaagaatgtccaatcgctgtagctaccttaaaacggagaacgtcctccccaaaaattctctgctgtatagcgaatacgagcttctcaacgaactgaataaagttaagattaagaacgagttcatcaacgtggtgctgaaaaatgagattatcgacgaactctttaagacaacctccaaagtcacaaagaaaaagttcgtggattatctgaaaaccaagcagatctttgttgagaaggaagacatttctgggcttgataacgagttcaaaagcaagctggactcctacatcaaatttaagaaagtgattggagataagatcgacaccctccggggctataatttcgtcgagaagtgcattgaatttaaatgtttctacggcgatgacaagaaactgtttaagaacgccatcaataacacagagttcaaagactacgtgagcgatgacgaactgaagaagatcaataaaatgaagtttaacaaatgggggagactttctaagcgcctcctgacggagatttgcttcgaaaatgttatcgagtccgagagcttcgaaaacattatcgtggctctgcggtctaccaattataactttatggagttcacatccaaaaagtttaatctcagcgaaaaggtcgccgaggaaaaccaggagaataccctggagaaattcaacattaacgaatacgtggatgagctttatgtctccccttctgtgaagagaagcatcattcaaacatacaaaatcgctatggaaatcaagaaaattaccggaaagaatccgaagaaaatctttattgagatggcccgcggcgggggagaaaagggcaaaaagacggagaaacggaaggagagaatcaaaacactgtatgcgaacatgaaggactccaatgaagagttcctcaacaatctggataacctgaagctctctgttgacaattacgatgacaaccgccttcgggaaaagaagctgtttctgtatttcatgcagctcgggaaaagcatgtacaccggaaagaatattgatctgaacgagcttctgtttgccaatacctacgacatcgatcacatcattccccagtccaaactcaaggacgatagcttcgacaacatcgtgctggtcgagaagacaattaataaagacaaggataacagagactatctggatgaatctatccggcttcgcatgaataaattttggaacttcctcagagagaagggcttcattaccatcgaaaaatacaatcggctgagacgcaacacatatttttccgacgatgagctgagcggcttcatctctcggcagctcgtgacgaccagacaatccacactggaagttaagaaactttttgagttcatttttcagaacaccgacgtggtctgcagcaaagctaatctggtgtctgatttccgcgagaagtacgggatcattaaagtgagagacctcaacgatgcccaccatgctcaggacgcctatctgaatatcgttgtcggaaacgtgtttgatacaaagttcaccaaaaattactggaagtttattgaagaccggcgcaaggtggacaacatcagagagacgtataatttcaaaaagatttttgattacgacgtcagccggggcgaaaacgtggcctggctgaaagattactccatcaataccatcagcgagatgattaacaagaaaacagctaatatcacccaaatgattacagaagggaagggacagcttttcgacctgaccatcctcaaaaagtctaagattgataaaaagctgacggttatccctaacacacccaaaatcctcaagtccagcctgaaagactcctgtaagattgcggagaagtatggctacttttctacccttatgcctgcctatttcgtggtcttcaaatacatcgataagaataaagaggtgtttgggttcgaccgcatttttatcttcgatagagaaaagattaacagcaatgaggacatcgaaaaatatctggaggataagggctacaactcccccaagtttatccggaaagttaacctcaagcagaaaattctgctgaatggatatccgtaccgcatcgtgggcttcacagacaacaaacttgaaattaaaaattctaagcagttttacagcgatggggagcacctgaagtatatcaaacatctctccgctttctacaacaataacaataacgtcaagaatggagagtatagaattaactttctgaaaaagacctctgaaaatgaccggaacgagaccacagacgaagccaaagagcgcctcaatatcgagttcattaagctgtacgaatatttttgcgagagacttaacagcaaaatctacgccaattattacaactccaagaagtacgatgaactgatcgaggtgttcgactgttttaaaaacctcaatctgctggataaggctaaacttctgctcgagttcctgaagattttcaaaaaggacacgtatggcaactttaagctcctggaaaaacctgagcttgataagaatgggaaacaaaagctggacaaaaacggaaatctgagcttcgaaggcctctctatggcctttgggaagctgaacggcaagaaattcaagcagcttgttgagaaagatatccagtttgtggacgaatccgtcaccggactgttcgagaagaaagaaggcctcgagaagtggcaggatggggagcaatga

SEQ ID NO: 4461 - RNA, 4215 nt, synthetic construct
  misc_feature 1..4215: note = Cas9 variant
  source 1..4215: mol_type = other RNA
atggccaagaaaatcctgggcctcgacctgggggtgagctccattggatgggctatcgtcgaggaagatgccgagaacgttatgaataacaagattgtgaaacttggcgtgagagtcaatcccctgaccgtggacgaacagatcaacttcgagaaggggaaacctattacaacgaatgcgggacggaccctcgttcgcggcgctagacggaacctgcaacgctttaaacttagacggctgcacctcatcgatatcctgcagaagcgcaatattctgaaacaggccgacctcctggccgaatctgggagaaacagcacattccagacccaagagatccgggctaagtccgccaaacagaaggtggagctttctgaactggctcgcgtcctcctgcttattaataaaaagagaggatacaagagctcccggaaagccaagaacgaggatgaaggccagatcgtggacggcatgtctgttgcgaaaaagctgtatgaggagaatacaaccccgggggaatacagctatgagctcctgaaatccggaaagaaacagctgagcgatttttaccgctctgacctccaagccgaatttgatagagtgtggaactttcagaagcagttctatcccgagattttctccgacaatctgtacaaggaacttcagggcaaaaacaagaatgctacatggaaaatcctggagattcctttcagcctcgtcgggatcaagcaagtgggaaccacgcaggagaaaaagatcgaaaagtatttttggcggtctgaggccgtgaaaaagcagctggatttcgaatcccttgctgtcgtttttcaagagattaacagcaacctgaataactcttccggctacctcggggccatcagcgaccgctccaaagaactgtacttcaataaccagaccgtgggagagtatctgcattgccagctcaaggagaatccccacacaaaactgaagaaccaggtgttttacagacaagattatcttgacgagttcgaaaagatttgggaaatccagtctaaataccataccgtcctgacaaaggagctcaaagaagagattcgggacgtgatcatcttctatcagagaaagctgaaaagccagaagggccttatttccatctgtgagtttgaaaatcgcgagattgaaatcaccgagaacggcaagattaaaaagaaagaggttgggctgaaggtggcgcctaaaagctctctcctgttccaagaatttaagatctggcaggtcctgaataacctccagttccagaatatcgagtccaaagaaatttttcccctggatcttgactgcaaggagagcatcttcaacgaagtgaatattaagggacggatctctgccaaagctgttctggatgtgctcggctacagcgggaaggagtggaaaacgaactttaaggacattgagggaaataactccaacgaaaatctgtataacgcctacctgaaaatcattgctaatgagggcatcgagttccctaaggaatttaagtgtaaccttgatgacgatatcaatgtctctaaaattatctgcagcgccgggaagattatcgagttcgtgagagaaaaattttccgagctcggaattaacacaagcatcctggacttcaattctgaactggagggcaccaactttgaaaagcaaaaatcctaccagctctggcatctgctttatagctacgatggcgacgattctccgtccgggaatcagaagctgtatgagctcctggaaaagaaattcggattcaagaaagagcacagcatcattctggccgacatcggctttccccaggagtacgggtccctttctacaaaggctatgcgcaaaattatccctcacctcaagaccggactgcccttcgcgaagaaaagcgacaacgataccattctgtccgccacagctatggccggctataatcactctaagagcctcacgaccgaggaactgacaaaacgggtccttaaggaacatctggagatcctccctaaaaactccctgagaaatcccgtggttgagaagatcctgaaccaaatgattaatgtggtcaacgaagtgatcaaagagtacgggaagccggacgaaattcgcatcgagcttgcccgggaactcaagaaaaacgctgaggagagagccaatatgaccagcgaaattggcaaggcgacaatccagcaccagaaatattctgagatcctgcaaaaggaatttggaattaaatcccctagccgcaacgatatcattcggtacaagctgtacctcgagctgtctaataacggcttcaaggacctttataccgatatccagattaaaagagaggaactgtttacggacaagtacgatatcgaccatattatcccccagtcccgcttctttgatgacagcttctctaataaagttctcgtgcctagaggggctaacctgaagaaaggaaatctgacagcctttgattatcttgagagcgaaggcaaggacaccctcgagaagttcatcaacaccattacagaattttacgataaagggatcattaccaaggccaaatatgagaagctgcagaaaaagggaacagaaatcggcgacgggttcattgagcgggacctgcgggatacgcaatacatcgctaagaaagccaaggagatcctctttggcattaccaattccgtcgtgagcacatctggacgcatcaccgacaaactgagagaagattggaaccttgtgaatacaatgaaggagatgaacctggaaaaatatcggaagagaggcctcaccgagacggttattaattccaagggggaggaaaaagagaagatcattgactggagcaaacgcaacgatcaccggcaccatgctatggacgccctgaccgtcgcgttcacaacccacaatcatatccagtacctgaactaccttaacgccagaaagaatgaagatcacaaacagcataaggtgatctccaacattgagaatctgatcacaaaagtgttcgaaaagaagaacggatctaaacagcgcagatttctcgagcccattcacaatttccggatcgacgctaagaaacacctggaggaaattctcatcagccataaggccaaaaacaaggtcgtgaccaagaatattaacaaaatcaagaaaaagggctccatcattgctaaaatcgagctgacgccccgcgggcaacttcacaaggaaacaatttatggatctagcaagtacctgaaaaccaaggatgagaaactctccggcaagtttgacctggaaacaatcaataaagttcagaacgagagatataagaatgccctgcttgagcggctgaaggtgttcgggtacgattctaaaaaggcgtttaccggcaaaaacattctcgccaagaatcctatcttcctgaacatcgaaaagaccgagcagctcccggaagtcctgacacttgcttggtatgagacgatttacaccatccgcaagagcattaattccgacaactttaaagattataagaatatcgacaaggtgacagacaaaaaggttcataacattctgaccgatagactccgggagttcaacggaaatagcaaagaagccttttctgacctggagaagaaccccatctggctgaataaacctaagggcatcgctattaagacagtgaccatcacgggggtcaacaatgtggaagcccttcactacaaaaaggatcacttcggaaaagagtttctggacgaaaagggccataaaattcccgttgatttcgtgtccacagggaacaatcaccatgtcgccatctacgaggacaccgctggaaacctccaggagcgcgtgctgagcttctatgaagcggtggagagagtcaatcaaggcctctctgttattgataaggaatacaactccagcctggggtggaagtttcttttcaccatgaaacagaatgagatgtttctgttccactctgaagactttaaccctcaggagatcgatctgtatgacgagaagaatctccggctgatttccaaaaaccttttccgcgtgcaaaagtttacagtgaaagattacttctttagacatcacctggaaaccaatgtcgaggacaacagcaagctcaagggcgacacatggaaacgggaaggactgaacggcatcagagggatcctcaaggtgcgcctgaatcaccttggaaaaattgttcaggtgggcgagtattga

SEQ ID NO: 4462 - RNA, 4215 nt, synthetic construct
  misc_feature 1..4215: note = Cas9 variant
  source 1..4215: mol_type = other RNA
atgagcaagaaaatcctgggcctcgacctggggaccacatccattggatgggccttcgtgagagaggctgaagattttcaggaggaatctagcatcgagcggattggcgtccgcgttaacccccttacgaccgacgaacaaatcaatttcgagaaggggaaacctatttccgtgaacgccgatagaacactgaagcggggagcgcgcagaaatctccagcggtacaaacagcgcagaaccaacctgatccagcttctgaagcaatataagatcattaatgagaacacaatcctcgctgaagacgataaaaataccacacactctacctacgccctgcgggccaaggctgtgagcgagaaaatttccaaggaagcctttgctcgcgtcctgctcatgatcaacaaaaagagaggctataagtctagccggaaagccaagaatgaggacgaggggcaggcgattgatggaatgtccgtggccaaacgcctgtacgaagaggacatcacgccgggccagctttgcctgcagctcctgaaggaaggcaaaaagaaacttcccgatttctatctgagcgacctccaagctgagctggaaaagatttggaactttcagaagaaattctaccctgagatcctgaccgatgagtttaagaaagaaatcgaggggaagggacagagagccacatctgcttccttctgggccaaatataagtttaataccgcggaaaacaagggcagccgggacgagaaaaagatgcaggcctgggaatggcgctctaaagctattaatacacaactcaccagagaggaggttgcctacgtgatcacggaaattaacaataacatcaacaattccagcgggtacctgggagctatttctgatcggtccaaggagctttatttcaacaaagaaacagtcggcgagtacctgtttagacagctccgctatagcccccatacccgggtgaagaatcaggttttctacagacaagactatctggacgaatttgagacaatctgggagaaccagtcccgctaccacaatgaacttaccaacgagctgaagtctgaaatccgggatgtggtcattttctatcagagaaaactcaagagccagaaagggctgatctccttctgtgagtttgagagcaagcaaattgaaatccagaaagacggaaagattgtgaagaaaatcatcggcctgaaggtgtctcctaaatccagccccctcttccaggagtttaagatttggcagatcctgcaaaatcttgagttcaccaacaaagagacaaaggaaaagaaggtccctgattttgaggccaagaatctcctgttcgaggaactgaacattaaaggcaatcttaagggggagaaagccatcgaaattctgggatacaagccgaaagagtggctcgttaactacaaggaactggacggcaatcgcacgaaccaggtgctgtatgaggggtacctcaagatcctggaggtggaaggatatgatattaaagaccttctgaagatcaaatctaataaggatgaggtcaacctcagcgaactgtccaaacccgtgtctgagatcaaggacctgattaagagcatctttgaatcccttaacattaataccgctatcctcgatttcaaccctgagctggagggcaaagactttgaacggcaggcgagctaccagctgtggcatctcctgtattcttacgagggggataattccaacacaggaaatgacgaactttatagactgctctaccaaaagttcggctttggcaaagagcacgcccagattctggctaacctgagcttctctcaggactacgggtcccttagcgccaaggccatgcgcaaaatctatccctttatcaaggaaaattcctactctgaggcttgcagcctcgccggatataaccattcctctagcattaccaaggaagaaaatgataaacgggagctgaaggaaaaactggagctcctgcctaagaactcccttagaaatcccgttgtggagaaaatcctgaaccagatggtcaatgtgattaacgcgatcattgctgacccgagcatgggccgccctgatgaaatccggatcgagctcgccagagaactgaagaaaaatgccgctgagcgggccgaaatgacaattcacatcaacaaggctaagtctgagcacgacaactaccgcaaaattctgaccacggagttcgggatccccaatcctacaagaaacgatattatccggtataaactttacgaggaactcaaagttaatggatataagaccctgtactccaacacctacatccccagagaaaaactgttcagcaaggagtttgacgtggaacatattatccccaaggccctcctgttcgatgactctttttccaataaaacaatttgtgcgcgccaagagaaccttgataagggcaataaaaccgccttcgactttatccagagcttctatgggaaggagaaatttgaagagtacctgcagcggattgaatctctcgctaagatcaaggagggcgatacattcgtcattagcaaagccaagtataaaaagctgctgcttcctgagatcgaaatcggagagggctttattgaaagagacctccgcaactcccaatacatcgctaaaaaggccaagagcatgctgctggatatttgcaaaacggtggtcccgaccacagggtctatcaccgacagactccgggaggactggggactgattaatatcatgcaggaacttaacttcgagaagtataaaaagctgggcctcatcgagatggtggagaaaaaggatgggtcctttaaggaacgcattacagactggaccaaaagaaatgatcaccggcatcacgcgatggacgccctgacggttgctttcaccaagcacaaccatatccagtacctgaattatcttaacgcccgcaaaaatgaaaaccacaagatgcatggaaacgtgattgctatcgagcagaaagaaacagagctgctcgtcgatagcgtgggcaagagaaaacggaagtttaagctgcccatttccaatttccgcgaggttgccaaaatgcacctcgaaaacatcctggtgtcttacaaggccaaaaataaggtcgctaccaaaaacaagaatagattcaagaccaaaaacggggagaaggtgaaaatcgaacttacacctcggggccaactgcataaggagacggtgtacggaaaaatgaagaagtatgaaacaaaagaggagattatcggcagcaagtttgacgaagcgaccattctcaaagttgccaatctggagcagcgcaacgctctgcttcagagactgaaggaaaataacaatgatcccaaaaaggccttctccgggaagaactctctcaaaagcaatcctctgtactatggagtcgactccaagcccatcccggagcggattaaaatcgtgtggctcgaggatgactacacaattagaaaggaaatcacccctgatctgaaaatcgacaaggtgattgatatcggcattcgccggatccttgagaacagactggccgaatttaatgggaacgctaaagaggccttctctaatctcgaaaagaaccccatttggctgaacgagggaaagcgcatcgcgatcaaacgggtcaccattagcggcgtgaagaatgctgagacactgcactataaaaaggaccaccttgggcatgaaatgctggacaaacagggcaagagaatccctgttgattttgtgtccacgggaaacaatcaccatgtcgccatttacaaggacgataaaagcgacctccaagagaaggtggtttctttctatgaagccgtggagcgcatcaaccaggaactgcccattatcgataaatcctttaatcacgacctcggctggcagttcctgtttaccatgaagcagaacgagtacttcgtctttcctcgggatgggttcgacccctacgagatcgatcttctgaatccggacaactataaaattatcagccctaatctgttcagagtgcaaaagattgctacaaagaactacgtttttaatcaccatctcgaaaccaaagccgtggatggagagctgcttaagaccaaaaaggacctgtctgacatcacatatcgcttcattcagacgcccgtcaacctcaaaaatatcattaaggtgcggatcaaccacatcggccagattgtgaagatcggggaatactga

SEQ ID NO: 4463 - RNA, 4218 nt, synthetic construct
  misc_feature 1..4218: note = Cas9 variant
  source 1..4218: mol_type = other RNA
atgaagaccatcctgggcctcgacctggggacaaacagcattggatgggcccttgtgaaagaggctgaaaattccaacgagaagtctgaaatcattaaactgggcgtcagagttaatcccctcacggtggatgagaagaccaacttcgaagccgggcggcctctgagcacaaatgcggaccgcaccgctaaaagatccgcccggcgcaaccttcagagatacaagctgcggcgcaagaatctcatcgatctgctgattaaaaaccaactcatcgacaaggatacaccgctgaccgagatcggcaaaaatacaacccaccagacgcttgagctgagagccaaggctgcccgggaacgcattgagctcgaagacctggctagagtgtttcttgccatcaacaaaaagcggggatatcgctctagcagaaaggtcaataacgaggaggaagggcaggcggtggatggaatggccgttgctaaaaagctgtacgacgagaatctcacccccggccagtatgcctacgaactgctgtccaaaggcaagaaatatgtgcctgatttctaccggtctgacctccaagctgagtttaacgccatttgggaatatcagaagcagttctacgcggatatcctggacgatgagctttacaatgccctgaaagggcagggacaacagaacagccgcaagagatttctcgctattaagggcgtctatacagccgagaacaaagggaagcgggacgacgtgaaactgagacattacaagtggcgctccgaagctatcagcaaaaagattaatatcgaggaagttgcctatgtgcttgtcgagatcaacaatgatctgaacaagtcttccggatacctcggcgccattagcgaccggtctaaagaactgtatttcaataaggagaccgtgggggagaacctgtggaaacagatccagaagaatccccacacatccctcaaaaaccaagtgttttacagacaggattatctggacgagttcgagcagatttgggaaacccaagctcagtttcatcctcagcttacgctggcgctcaaggagcagatccgcgatgtcattatcttctaccaacggaagctgaaaagccagaagggacttctgtctttttgccagttcgaatcctgggagatcgagagaaaagacgaaaatggcaacgttattctcaataagacaacccagctgcccaaacgccaaacagtgggccggagagtggcccctaagagctccccgctgtttcaggagttcaagatctggcagaacattaataacctcgaagtcaccaaaatctctgagggggctagcaagaataaaaaggagaccgaaacactgtccgatgacgagcgcaaacttctgttcgaagaactcaacctgcggggaaacctgagccagaaggaagtgcttcaaattctcggcctgaaagataaggagtacaagacgaatttttctgaggggctggaaggaaacagaaccaatgccgccctcttcaacatctatcagcagatcgctgagaatgaaggctacgggtttgactggtccaaaaagagcgcccaggagattaaagaagaactgaaggcggttttcccccaaatcggcattcaggctgatatccttgactttaacgccaatctggacggaaaagagttcgaaaaccaggcctcttatcaactctggcatctgctgtacagcgctgaggaagatgacaagattaatgaggaagatcagatcatttatggcaactccgccgtgtctcttaagaaaaagctctgtgagaaatttgggttcacacctgagtacgctaagtggatcgccaatgtcagcctgcaggacgattatggaaacctgtccaccaaagcgatgcgcaagatcattccctacctcatcgacggcaatgattacagcgaagcctgcgctctggccgggtataaccactctaattcccttacaaaggaggaaaacgacaaccgggagctgctcgataaactggagctgcttcctaagaatagcctcagaaaccccgtggttgagaaaattctgaatcagatggtgaacgtcgtgaatcaagtcatcgagacctacggaaagccggacgaagtgcggattgagctggctcgcgaactcaaaaagtctgccgagaagagagcggagatgacgaaatccatcaacgaagccacacggagaaatgaggatatcaagaaactgattaccaaggactttggcatccctaaccccaccaaaagcgatgttgtgcgctatcggctttgggaggaactggctcctctcgcctacaaggacgtcttcacagggaaacagattaagaaggaagacctgttttcctctaaaatcgatattgagcacatcatccccaaggctctgcttttcgacgatagcttttccaataaaaccctcgtgttcagagagacaaacctgaagaaagccgaccgcacggcctatgatttcattgaatctgactacaatgctaccctggatgactatatccagagagttgagacactctacaacaataccaagggcacaattagcaagggaaaacggaacaagctgcttatggcgcagaaaaatctgcccgatggctttatcgaacgcgacctcagaaactcccaatacattgccaagaaagctaaggccatgctgtatcaggtgttcaaggatgtcaacgtgaccagcgggtctatcacggaccggctgcgcgaggattgggaccttatcaatgtgatgaaagaactgaactttcctaagtacaaagccctcggactgaccgagattgaggaaagatatgacatcggccaggagaagacaaaacgggttgaagtcattaccgattggacaaagcgcaatgaccacagacatcacgctatgaacgccctcaccgtggcgttcacgacatccagccatatccagtacctgaattatcttaacgctcggaagaatgagtctcacaaagagcacaagaacattaaagggatcgaaaataagattacccataaacaaaaggataagcgcaaatttatcccgcccatgcctaacttcagagaggaagccaagaaacacatcgagacaattctggtgtccatcaagaataaaaacaaggtctacaccaaaaatattaacaagaccaagaaaaagagcggacataatacaaaagaacagctcacgccccggggccagctgcacaaggagaccgtgtatgggaaatctaagagacctatgagcaagcccacaaaaatcaacaagaatttttccctggagcaagcccagcttattatcaacgttcaggaaaaagagctggtgctccgccatctggctcagttcgacaacaatccggccgtcgcgtttgataccaagacactcaaaaagatgcctctgcttaagaacggcgaacccctgaaagaggtgctctgtttcgaagagatctttaccattcggaaggacatcacgcctgatctgaaaattgagaaggttgtggacgagaaaatcaaggctattctggaacaaagaaagaaagatttcggaggcaatgccaaggaagcctttagcgaccttgataaaaaccccatctggctgaataagaaaaaggggatctgcattaaacgcgtcacaatcaccggagtgtctaacgctgaggccctccaccaccagaaggaccatctgggccgggaaattctcgacgataatgggaaccctatccccgctgacttcgtttccaccggaaataaccaccatctggccgtgtaccttgatagcgagggcaagctgcaggacaatattgtctccttctacgaggcggtggtgagaacatctcaggggctgccggtcgttgataaaggcctcaacaaggacctgggatggaaatttcttttcagcctgaagcaaaatgaaatgtttgtgttccctaacgatgactttgatatcaatgacttcgatctcctggacgataaaaaggccgagctcatttccaagcacctgtatcgcgtgcagaaaatctctaaggtcagcgctggcaactcctttgtgcgggacatcgttttcagacaccatcttgaaaccacagtgaaagaggtcaaggagctgaaagacatttcttacatccagctcaagagcctggaagggctgcgcaacattaagaaagtgcggatcaatcacattggaaagatcgttcaggtgggcgagtattga

SEQ ID NO: 4464 - RNA, 4221 nt, synthetic construct
  misc_feature 1..4221: note = Cas9 variant
  source 1..4221: mol_type = other RNA
atggagaagaaaatcattggcatcgacctgggggtgaccagcattggatgggcctacgtcatcgaagatgagaacggccactcccggattctcagaatcgggacacgcgttaatcccctgacgaccgaggaacttaagaacttcgaacagggaaaacctatcacagagaccgctgagagaacactgaagcggtctatgcgcagaaatctccaacggtataaacagcgcagaaccaacctgattaatgtgcttctgaagaacaagctcatcacagaaaccacggccctggcggaggacggcaaagggaccacacatctgacccacgctctccgggccaaggccgcttacgcccagattccgctggaagattttgctcgcgtgcttctgatgctcaataaaaagagaggatatcggagctcccgcaaagtcaagacagaggccgacggccaggcgatcgatggcatggccgtggctaagaaactgtacgaggaaaacattacccccgggcaactttgctatacgctgctcctgcagggaaagaaaacactgcctgacttctacagatctgatctccaggttgagatggaaaaggtgtggacctttcagaaacaattccatcaggccatcctgacagacgagtttcggaagtatattgctggcaaagggcagcgcgccaccgcggccagcttctggggaaagtacggctttaataccgctgagttcaaggggtccagagaagagaaaaagctgaaatcttacgaatggcggagccaggccatcacaacgcccctttcccaagaggaagtcgctgccgtgatcaccgatattaacagcaatatcgccaactcttccggatatctcggcgctattagcgacagatctaaggagctgtttttcaataaacagacagttggccagtaccaatataaccttctgcagcagaatcctcacaccaacctctccggacaggtgttttaccgccaagattatctggacgagttcgaaacaatctgggagacccaggcgacgtttcatacaatgctgacccccagcctcaaggaagagattcgggatatcgtcatcttctaccagagaaagctgaaatctcagaagaaacttgtgtccatttgtgagttcgaaaagcgcatcctggaacctctccaaggggacaaagtggtcggctataaggttgcccccaagagctccccgctgtttcaggagttcaaaatttggcaggctcttgggcggatggagatccagcacaaggtgaccaaagaaagacactttctggacctcgatgccaagcaactgctgttcgacgagctcaacgtgaaaggagatctgacaaaggaaaatgcccttaccattctgggctttaagcctaaagagtgggagtgcaacctcctgaagctggaagggaatcgcacaaaccaggctctttacgaggcctacctcaaaatcctggaactggagggatatgaagtcaaggacctcctgggccttaaactggataaggacgatatcaaactctctgagctgcccgtggacgcggctgatattaagaagatggttcgggagatcttcgaaacgctgaatattaaaaccagccttctcgactttaacgccacactgcctggcaagtccttcgagcagcagcatgcctaccaactgtggcacctcctgtatagctacgaaggggataattctccctccggaaacaaaaagctgcaggaccttctccaggctaaatttggcttcaccaatgcccatgggcaaatcctggctaacgtgagcctggagacagactatggatctcttagcgccaaggcgattagaaagatctttacccacattaaagaaaatcactactccgccgcttgtgccctcgctggctataaccattctagctacctgtccaaggaggagaatgaacagcgcatcctgaaagatcggctcacgatcctgccgaagaacagccttagaaatcctgtcgtggagaaaattctgaaccagctcatcaacctgctgaataccattttcgacgatccctaccttgggaagcctgacgaaatccgcattgagctcgcccgggaactgaagaaaaacgttcaggagagacaacggctgaatacagagatcaccaagaacaatacagaacacgagcgcatcaccaaaattctcatcaaggaagataacattaaaaatcccacgagaaacgacatcattcggtataagctgtaccaggagcttaagcataatggctataaaacactgtactctaacacctatatccccagagaggaactctttggaaagaatttcgatatcgagcacattatccctcagtccattctgttcgacgatagcttttctaacaaaacactgtgcgtgcgcaaggaaaatatcgacaaagcggatcggaccgccatggacttcattggcccgtactttggggaggataaggtccaggaatatatcaacagagtggagatgcttcatcaaatcaatctgaaaaaccccgaggaaggaattggcaaggggaagtacaaaaagctcctgatgaaggcttccgagatcggacagggcttcattgaacgcgacctcagagacacccagtacatcgccaagaaagctcggcagatgctgcttgaggtcacacgcacggtggttgccaccacagggagcattaccaagagactgcgggaagattggggcctcgtgaacgtcatgcaagagctgaatatggacaagtatcgccagcagggactgacagagcttatcgaaaagaaggatggctccaccaaagagagaattacggactggacaaagcggaacgatcaccgccaccatgccatggacgctctgaccatcgcgtttaccaaacactctcatatccaatacctcaataacctgaatgccagaaagagcgatgacaagaaagggaaggaaattttcggaatcgagcagaaagaaacagagaaggtgaaagatgacaccggccagacacagcggcgctttaagctccctatgcccgatttcagacaagctgccaagcaccacctggagcatcttctgatttcctttaaagccaagaacaaagttttcacgaagaataaaaacaagtataagaccaaaaatggggaacaggtgaagctcgagctgacacctcggggacagctgcacaaagaaaccatctacggcagaattaagaaatatgtcacacatgaggagaaggtgtctagcaaatttaacgctcagcttatccaaaccgtggccaattccaagtaccgctatgcgctgctcaagcggctggaagagaacgggaatgaccccaaaaaggctttcacgggcaaaaacagcctcgataagaccccgctgtttgttgacgccacacagcaggagaaaatccctcccgtcgtgaaacttgtgtctattgaacagggatacaccatcagaaaggacattacacctgaaaatttcaaagatgccaagtccatcgagaaaattgtcgacgtgggcatccgcaacctgctgcaccatcggctcgagacctacaacgggaatgaaaaggaggctttctataacctggataaaaatcccatctgggttaacgaaagcaagggaatttgtatcaagagagtgacaattaccggcgtcacgaatgccgagcctcttcactacaaacgcgaccaccatgggaagcccatcctggataacaatggaaaccggacaccggcggactttgtgtctaccggcaataaccaccatgctgccatttatagagatgccgctgggaatctccaagacaacgttgtgtccttctacgaagccgtcgctcgcgtgaatcagggcctgcctatcattgataaaagcctcaacaaggagctgggatggcagtttcttttctctctgaaacagaatgagtgctttgttttccccaacgaaggctttgaccccctggagatcgatctctataatcctgccaacaacaagctgatcgcggccaatcttttccgggtgcaaaactttagcagactgcagtacgggaataacattatccgggactataatttccgccacatttacgaaacctccgtcgagaacagaaaggaactcaaagacatcgcttacaaacaggtgaaaagcctgccgatttttgagaagatcatcaaagtgcggattaatcatatcggacaaattgtcaagacaggcgagtattga

SEQ ID NO: 4465 - RNA, 4224 nt, synthetic construct
  misc_feature 1..4224: note = Cas9 variant
  source 1..4224: mol_type = other RNA
atgatcagaaacattctgggcctcgacctgggggtgagctccatcggatgggcctacgtccaggaggattctaagaatagcgaaaacaatcggattatcaaacttggcgttcgcgtgaaccccctgaccgtggacgagcaactcaatttcgaaaaggggaaacctattacaacgaacgctggaagaaccctggcccggtccgcgcgcagaaatcttcagcggtttaagctgcgcagatctaacctcatggatgtcctgaaaaagaataacatcctgaaggagacagacctcctggctgaagtgggcaaaaatagcaccttccagacacaggagcttcgggccaagtccgccaaagagaagatcgaactgtctgagtttgctcgcgttctcctgcttattaacaaaaagagagggtataagagctcccggaaagccaagaatgatgaagacggacaaatcgtggatggcatggctgtcgccaaaaagctgttcgaggagaacctcaccccgggcgaatacagctatcagctgctgcagcaggggaaaaagcaactccccgacttttaccgctctgatctgcaggcggagttcgacaaaatttgggattttcagaagcagttcaatcctgaaatctttacaaacgagctttatgaaaagctgcaaggaaagaacagaaatgccacctggaaggagctcgagttccccttttccctggtgggcattaaacagacggggaccatgcaggaaaagaaagttgagaagtacttctggcggagcgaagctgtgaagaaacaacttgactttgagtctctggccgtcgtgttccaggaaatcaactccaatctcaacaatagctctggatatctgggcgctatttccgatcgcagcaaggagctgtacttctacaaccagacagtgggggagtatctctttcagcaactgaaaaccaatcctcacacaaaacttaaaaaccaggtcttctacagacaggactatctggacgaatttgagaagatctgggaaacccagtccaagtaccataaagagctcacgaaggaactgaaagaggagatccgggatattacaatcttctatcaaagaaaacttaaatctcagaagggactgattagcatctgcgaatttgagaatcgcgaaattgagatcaccgagaacggcaagaccaaaaagaaaaccgttggcctcaaggtggcccccaaatccagccctctgttccaggaatttaagatctggcaagtgctgaataacctccagttccagaatattgagaccaaagaagtctttccgatcgacctggatttcaagcagtctatttttgacgaggtgaacatcaaggggaaactttccgcgaaggatgttctggacctcgtgggatacagcggcaaagaatggaagacaaatttcaaagagattgaggggaactatacgaacgaaaatctgtacaccgcctttctgaagatcatcgcttctaaggagattgaatttcccaaagagttcaagatcacaattgatgacgaaatcaaagtcagcaagattaacgcctccgctgagatcattaaacttttcgtgcgggagaagttctctgaactcggaatcgataccagcatcctggactttaatcctgagctggaaggctccgatttcgagaagcaggccagctaccaactctggcatctgctttattcttacgaaggggacgactccagctctggaaacgagaaactgtatgagctcctggaaaataagtttggcttcaaaaaggagaactccaaaattctggccgaaatcggctttagccaggattacgggtccctttctagcaaggctatgagaaagatttatccctacatcaaagagcacaagtattccgttgcgtgttcttacgccggatacaatcacagcaaaaactccctcacaaaggagcagctggaaaatcgcattctgaaagagcggctcgacatcctgcctaagaacagccttagaaatcccgtggtcgaaaagatcctgaaccaaatgattaatctcgtgaactgcctgatcgatgagtattctgaaaaggacaaggatggccagattgtcaaatacttcaagtttgacgagatccgcattgagctggctcgggaacttaaactcaatgccgaggaaagagccaccatgacgtccgagatcaacaaggctacaatccagcatcagaaatatgccgaagtgctgcaacgcgagttcgggctgaaggcgccgagccggaacgatattatcagatacaagctctatctggagcttgctaataacggatttaaagacctgtacaccgatgccaagattgaacgcgagaatctcttcaccgacaaatatgatatcgaccacattatccctcagtctcggtttttcgatgactccttcagcaacaaggttctggtgcccagaaatgccaacctgaaaaagggcaattttacagctttcgactaccttgaaatcgaggggaaggaaaaactcgagaagtttctgaacattatcaaagatctgtacgacaagggcgccattaccaaagctaagtatgagaagctccagaaaaaggatttcgaaatcggagacggctttattgagcgggatctgcgcaatacacagtacatcgccaaaaagtctaaagaaattcttttcgggatcacgaacagcgtcgtgaccacatccggaagaatcaccgacaagctgcgggaggattggaatctcattaacacaatgaaggagctgaatctggaaaaatatagaaaacttggcctgaccgagacggttatcaacagcaaaggggaagagaagcaacgcattatcgactggaccaaacggaatgatcacagacatcacgcgatggacgccctcacagtggcttttaccacacataaccacattcagtacctgaactatctcaatgcccgcaaggatgaaaaacacaaggagcatcagaacatcttcgctatcgagaatctgattaccgaaatcattgacaagaaaaacggatctaaggagagacggtttaaagaacctgtcaagaatcttcgcgccgaggcgagaaaacacctggatgaaatcctcatttcccataaggtgaagaacaaagtggttacgaagaatatcaacaaaatcaagaaaaagggcagcgtcattgccaagacagagctgacaccccgggggcagctgcacaaagagacaatctacggctcctctaagttccttaaaaccaaggaagagaaaattagcggaaagtttgacgtggaaaccatccaaaaggtgcagaatgagcgctatagaaacgctctgctcaaacggctgcaggagttcggcggggactccaagaaagccttcacaggaaagaatgtcatttctaaaaaccccatctttctcaataacgaaaagacggagcaactgcctgaaaccgtgacacttgcttggtacgagatgggctacaccattcgcaaagccgttaatccggataacttcaaggactttaagaatatcgaaaagacaatcgataaggggattagagacatcctgaccaaacggctcaaggagttcaacggaaacagcaaagaggccttttccgatctggacaagaatcccatttggctgaacaagtctaaaggcatcagcattaaggctgtgacgatcacagggatcaataacgcggaagcccttcattataaaaaggatcacctgggcaaagacttcctcgatgagaatggaaagcgcattgctgtcgactttgtgtccaccggcaacaatcaccatgttgccatctacgaagatgagaacgggaatctgcaggaaaaggtggtcagcttctatgaggccgtggagagagttaaccagaatctccctattatcgacaaagaatacaactctgagtccggatggaagtttctgttcaccatgaaacagaatgaaatgtttcttttccccagcgaggactttaaccctaaggaaatggatctgttcgacgagaaaaatgtgaacctgatttctaagaacctcttccgggtccaaaagtttacaatcaaagattatttctttagacaccatctggagaccaatgtggaagactccagcccccttaagggcatcacatggaaacgcgaggggctgaacggaattgaaaatatcctcaaggtgcggctgaaccacctcggcaaaattgtccagatcggggagtactga

SEQ ID NO: 4466 - RNA, 4227 nt, synthetic construct
  misc_feature 1..4227: note = Cas9 variant
  source 1..4227: mol_type = other RNA
atgaccaagaacatcctgggcctcgacgtgggggtcagctccattggatgggccctgatcaatgaggatattgaaaaccccaaaaataacaagatcattaaacttggcgttagagtgaatcctctgacagtggacgagcagatcaacttcgaaaaggggaaaccgatcacgaccaatgctggacggacactcgcccgcggcgcgagacggaacctgcaacgctttaaacttagacggttccacctgattgatatcctccagaagaataacattctgaaacaggctgacctgctcgccgaggtcgggaaaaattctacctttcagacacaagaaatccgcgccaagagcgctaagcagaaagtggagctgtccgagcttgccagaattttcctgctcatcaacaagaagcggggatacaaatctagccgcaaggctaaaaatgaagatgagggccagattatcgacggcatgtttatcgccaagaaactgtatgatgaaaaacttacccccggggagtactcctatcagctgctcaaggagtctaagaagcaactgcctgacttctacagaagcgatctgcagtccgaatttgacaaaatttggaacttccagaagcagttttatcccgagaatttcagcgataacctctacaaagaactgcaaggaaagaacaaaaatgcgacatggaagacccttgagatccctttttctctggttggcattaagcagacggggaccctccaggaaaagaagctggagaaatattcctggcggagcgacgccgtgaagaaacaacttgattacgagaagctggctgtcgtgttccaggaaatcaactctaatatttacaactccagcggatatctcggcgccatctctgaccgctccaaggagctgtactttaataaccagacagttggggaatatctgtacaatcagatcaaagagaacccccataccaagctcaaaaatcaagtgttctatagacaggactacctggatgagttcgaaaagatttgggagacacagagcaaatatcacaccacgcttacaaaggaactgaaggaggaaatccgggacattatcatcttttaccagcgcaaactcaagtcccaaaaaggactgatttctatctgcgagttcgaaaacagagagattgagatcaaggaaaatggcaaaattaagaaaaagaccgtcggccttaaggtggctcctaaaagctccccgctgtttcaggagttcaagatctggcagattctcaacaatctgcagtttcaaaacatcgaaagcaaagagattttccccatcgatctggactttaaggagtctatcttcaatgaagtgaacattaaagggcggatctccgccaaggcggtcctcgatctgcttggatacagcggcaaggagtggaaccctaattttaaagacattgaagggaacaatacaaacgagaatctgtataacgcctacctcaagatcattgctgatgaagagttcgagctgcccaaagaatttaagctgaatggagacgatgacctttatgtttctaaaatcgcctgtagcgcttccaagatcaaggatttcgtgaaagagaagttttctgaaattggcatcaacaccagcattctcgacttcaatcctgagctggaagggaaagacttcgagaagcaggcctcctaccagttttggcatctgctctatagctacgagggagatgactctcagtccggcaacgaaaaactgtatgagcttctggaaaagaagttcggctttaaaaaggagcacagcaaaatcctctctaatattgggttccccctggattacggaaacctgtccaccaaggccatgagaaaaatcatcccgcatcttaaggctggcctcagctttgcgaaaaagtccaaggaagacaatattctgtctgccacagctatggccgggtacaaccacagcaattcctatacgaaagaggatctggccaagcgcgtgctcaaagagaagctggaagtcttccctaaaaactctcttcggaaccccgtggttgagaagatcctgaatcaaatgattaacctcgtgaatgaagctgtcgaggagtacggaaccatcgacgaagtgagaattgagctggcccgcgaactgaagaaaaacgcggaggaacgggctaatatgacaagcgagatcggcaaggccacccttctccaccagaaatatgccgagatcctgaagaaagaatttgatattcctgttccctccagaaacgacatcattcgctacaagctgtatctcgagctggctaataacgggtacaaggatctttatacagacgtgcagatcaaacgggaggaactgttcaccaataagtacgatattgaccatatcattccccaaagcagatttttcgatgactctttttccaacaaagtcctcgtgcctcgcggcgccaatctgaagaaagctaaccagacggccttcgactacctggaaaatgaggataagcagaaacttgagaagtttctcaacatcatcaagaatctgtatgacaaaggagaaattacaaaggcgaaatacgagaagctgcagaagaaaggcagcgatatcggggaaggattcattgagcgggacctcagagatacccaatatatcgccaagaaagctaaggaaattctgttcggcatcacccactctgtcatctccacaagcgggaaaattaccgacaaacttcgcgaggattggaacctggtgaacacaatgaaggagctcaatctggacaagtacaagaaactgggacttacggaaaccctgctcaactctaagggcgaggaaaaagagcggatcattgattggagcaagagaaatgaccatcggcaccacgccatggatgctctgacagttgcctttaccacacataaccacatccagtatctcaattacctgaacgcgcgcaaagacgaggatcataagcagcacaaggtgatttccaatatcgaaaaccttatcaccaaagtcttcgagaagaaaaatggggccaagcagagacggtttattgaaccgatcaacaatttcagagtggacgctaaaaagcatctggacgagattctcatcagccacaaggccaaaaacaaggttgtgacgaaaaatattaacaagatcaaaaagaagggctctgtcgtggctaaaaccgaactgacaccccgcggacaactgcacaaggagaccatttatggctccagcaaatttcttaagacaaaagatgagaagatctccgggaaattcgacctggaaaccatcaataaggtgcagaacgagaagtacaaaaatgccctcctgcagcggctcagagaatttggagaggattctaagaaagccttcacgggcaagaacgttattagcaaaaaccctatctacctggacgaagagaagacacttcagattcccgagtccgtcaccctggcttggtatgaaatgatctacacaattcgcaagcctgtgaatcccgataactttaaagactataagaatatcgataaagtgaccgacgagaagatcagagcggtcctcaccgatcggctgcgcaaattcaacggaaattctaaggaagcctttagcgacctggagaagaacccgatttggcttaataaatccaaggggatcgctattaaaacagtgacgatcaccggcatgtctaacgttgaagccctgcattacaagaaagatcacctcgggaaggagattctggacaagaaaggcgacagaatgcctgtggatttcgtcagcacaggaaataaccatcacgccgctatctatgaggacgccaagggcaatctccaagaacgggtggtttccttctacgaggcggtggaacgcgtcaaccaggggctgagcgtggttaataaagattataacgctggacttggctggaagtttctgttcaccatgaaacagaatgagatgtttctgttcccctctgaggactttaaccctaaggaaatcgatctctacgacgagaaaaacctgaaacttattgccaagaatctgttcagagtgcaaaagtttggggaactctccaagagcggattctggtttcggcaccatctggagacatctgtcgatgtgaaaaaggaactccgcaactactcctatctggacttctacagcaaagattttatgaagaccatcgtgaaggtcagacttaatcacctgggcaaaattgttcaggtgggggagtattga

SEQ ID NO: 4467 - RNA, 4230 nt, synthetic construct
  misc_feature 1..4230: note = Cas9 variant
  source 1..4230: mol_type = other RNA
atgagcatcattaacttccagagacggggcctgatggagacccaagcctccaatcagctcatctctagccacctgaaggggtaccccattaaagactattttgtgggacttgatatcggcacatcctctgtcgggtgggctgttacgaacaaggcctacgaactgctcaaattccgcagccataagatgtggggatccagactgtttgacgagggcgaatctgcggtggctcggcgcgggttcagaagcatgcggcgcagacttgagcggcgcaaactgagactcaagctgctggaagaactctttgccgatgccatggctcaggtggaccctaccttctttatgcggctgcgcgagtccaagtatcactacgaagataaaacaaccggacatagctctaagcacattcttttcatcgacaaaaattatacagatcaggactactataaggcctacccgaccatctaccatctgagagctgagctcatgaaagatggcacagacgatattcggaagctgtttcttgccgtccaccacatcctgaagtatcgcggcaacttcctctacgaaggggcgacctttgactccaatgccagcacgctggatgacgtgattaaacaagctctggagaacatcaccttcaattgctttgactgtaactctgccatttccagcatcggacagattctcatggaggctggcaagacaaaatctgataaggccaaagcgatcgaacatctggttgacacctatatcgccacagataccgtggacacgtccagcaagacacagaaagatcaggtcaaggaggacaagaaaagacttaaggctttcgccaatctggtgctcgggctgaacgcttcccttattgatctgttcggatctgttgaggagctcgaagaggacctgaaaaagctgcaaatcaccggcgatacatacgacgataaacgggacgagctcgccaaggcctggagcgacgaaatttatatcattgatgactgcaagtccgtgtacgatgctatcatcctgcttagcattaaagagcccgggctgaccatctctgaatccaaggtcaaagcgtttaataagcacaaagacgatctcgccattcttaagagccttctgaagtctgacagaagcatctataacaccatgttcaaagtggatgagaagggactccataattacgtgcactacattaaacagggccgcacagaagagacgtcctgtaaccgggaggacttttataagtacaccaaaaaggtcgttgaaggcctgcctgattctaaggacaaagagtatatcctgagcgaaatcgagctccagacactgcttcccctgcagagaattaaggataatggggtgatcccttaccaactccacctggaggaactgaaagtgattcttgctaagtgcggacccaaattcccttttctcaacgaggtcgccgacggcttctccgtggccgaaaagctgatcaaaatgctggagtttcgcattccgtattacgttgggcccctcaacacccatcacaatgtggataacggaggcttcgcttgggccgtccggaaggcgagcgggagagtgacaccttggaattttgacgacaagatcgatcgcgaaaaatctgctgccgccttcattaagaacctgaccaataaatgtacgtatcttctgggagaggacgttctccccaagtccagcctgctgtactctgagtttatgcttctcaacgaactgaataacgtgcggatcgatggcaaacctctggagaaggctgtcaaggaacatctcatcgaggccgtgttcaaacaggaccacaagaaaatgacaaagaatagaattgaacagtttctgaaagataacaattacatccccgagaagcataagccggagattaccggccttgacggggaaatcaaaaacgatctggcttcctatcgcgacatggtccggattctcggaaataacttcgatctgagcatggccgaggaaatcatcaccgacattacaatcttcggcgagtccaagaaaatgctgagagaaacccttcgcaataagttttctagccggctcgatgacgaggcgattaaaaagctgtccaagctgagataccgggattgggggcgcctctctagaaaactgcttaacgtgatcgagggatgcgacaaggccggcgacgggacacctgaaacgattatcatcctgatgcggaacttcagctataatctcatggagctgctgggcgataaattttccttcatggaacgcattcaagagatcaacgctaagctgattgaaggacagatcgttaatccccacgacattatcgatgacctcgccctgagccctgctgtgaaaagagccgtctggcaggcgctgcggatcgtggatgagattgttcacatcaagaaaaccctccccgccagaatttttgtggaggtcacacgctctaacaaggctgaaaagaaaaagaaagactccagacagaagcggctgagcgatctttacgccgctatcaaaaaggacgatgccctgctctctggcctgaccaatgaggagttcgggggactgaagtccggccttgccaaatatgacgatgctgcgctgcgcagcaagaaactctacctgtattacacacaaatggggagatgtgcctacaccggagaagtgattgacctctctcagctgaacacggacaattatgatatcgaccatatttacccccggagccttaccaaggatgactcctttgataacctggtgctctgcaaacgcacagctaatgcccaaaagagcgacacctatcctatctctaaggagatccagaaagcccagaaggctttctggatttttctgaaacagcagggcctgatctccgaaagaaagtacgagcggcttacacgcattaccccgctgacggccgatgacctcagcgggttcatcgcgagacagctggttgaaacaaaccaatccgtcaaagctgccaccacactcctgcggcgcctttatcccggcgtggatgtggtctttgtgaaggccgagaatgttaccgacttcagacacgataacgactttattaaggtgcggtctctgaatcatcaccaccatgctaaagatgcctacctcaacatcgtcgtgggaaatgtttatcacgaaagattcacccgcaacttccgggcgtttttcaagaaaaacggcgctaatagaacatacaacctggccaagatgtttaattacgacgtgaactgtacgaatgccaaagacgggaaggcttgggatgtcaagaccagcatggacacagtgaaaaagatgatggcctccaacgatgttcgcgtgaccaaacggctgcttgagcagtctggagctctggccgacgcgacagtctataaggccgctgtggccgagaaagctaaggatggcgcctacatcgggatgaaaaccaagagctccgtgttcgccgacgtctctaagtatggaggcatgacgaaaattaagaatgcttacagcatcattgttcagtatgcggggaaaaagggcgaagtggtgaaagagatcgtccctctccccatttacctgacaaacagaaataccaccgatcaggacctcatcgattatgtggcctccatcattcctcaagctaaggacatcagcattatctaccgcaagctgtgcattaaccagcttgttaaagtgaatggattttactattacctgggcgggaagacaaactctaaattctgtatcgataatgccattcaggtcatcgtgtccaacgaatggatcccctatctgaaggttctcgagaaatttaataacatgcggaaggacaacaaggatctgaaagccaatgtgattagcaccagagctcttgacaacaagcatacaatcgaagtccgcattgtggaggagaaaaatatcgagttctttgactacctggtttctaagctcaaaatgccgatttatcaaaagatgaagggaaacaaagccgcggaactgtccgaaaagggctacggactcttcaaaaagatgagcctggaggaacagtctatccaccttatcgagctgctgaatctcctgacgaaccagaaaaccacatttgaggtgaagcctcttgggattaccgcttcccggagcacagtcggctccaaaatcagcaatcaggatgagttcaaggtgattaacgaatctatcaccgggctgtatagcaatgaagtgacgattgtctga

SEQ ID NO: 4468 - RNA, 4233 nt, synthetic construct
  misc_feature 1..4233: note = Cas9 variant
  source 1..4233: mol_type = other RNA
atgaccaagaacatcctgggcctcgacctgggggtgagctccattggatgggcccttgtccaggaaaattctaaaaaccccgaaaataacaagatcgttaaactgggcgtgagagtgaatcctctcacagtcgatgagcaaattaacttcgaaaaggggaaaccgatcacgaccaatgctagccggacactggcccgctccgcgagacggaaccttcagcgctttaagctgagacgggctaatctcattgacgtgctgaagaaaggaaacatcctgaagcagggcgatctcctgaccgagatcgggaaaaattctacattccagacccaagaacttcgcgccaagagcgccaaagagaaggttgagctgtccgactttgtgcggattctcctgcttatcaacaagaaaagaggatacaagtctagccgcaaagctaagaatgaagatgagggccagattatcgacggcatggccgtcgctaaaaagctgtatgaagagaacattacacccggggagtactcctataaactcctgcaggaaggaagaaagcagctgcctgatttctaccggagcgacctccaagccgagtttgataagatctggaatttccagaaacagtttaaccccgaaattttcaccaacgagctgtataagcgccttcagggcaaaaatagaaacgcgacgtggaaggaactggagatccctttttacctcgtggggatcaaacaaattggaaccatgcaggagaagaagatcgaacggtatttctggcgctctgaggccgttaaaaagcagctggactttgaatcccttgctgtggtcttccaagagattaatagcaacctgaataactcttccggctacctcggggccatcagcgatagatctaaagaactgtactttaataaccagacagtgggagagtatctgtacaatcagctcaagattaacccccacaccaaactgaagaatcaggtgttctatcggcaagactaccttgatgagttcgaaaagatctgggagacacaggctaaatatcataagaaactgaccaaggaactcaaagaggaaatcagagacattgtcatcttttaccagcgcaagctgaagtcccagaaaggccttattagcttctgcgagtttgagaaccgggaaatcgagattacggttaatggcaagacaaagaagaaaaccgtggggctgaaggtggtccctagatcctctcccctcttccaagaatttaaaatctggcagcgcctgaacgacctggagttcaagaatgtggagacaaaggaaatctttccgctcgagctggaacacaaagagattcttttcggaaacctgaacatcaagggcaatctcagctccaaagaactgattgagcagctggggtatcctagcaaggagtggaaatgtaactttaaggaaatcgatggaaataagacccatgagaacctttacaccgccttcctcaaaattatcgcgaatgaaggcattgagtttcccaaggagttcaaactgtctatcgacgatgacatcaaggtttccaaaattgatgtgagctctgagaagatcaaggagtttattaaagaaaacttcctgaagctcgggatcaatacaagcattctggacttcaaccctgagcttgatggaaaagactttgaaaagcaggagtcctaccaactgtggcacctcctgtattcttacgaaggcgatgacagcgcctccggcaatgagaaactgtatgagcttctcgaaaagaagttcgggtttaaacgggagtacagcaagatcctggctgatgtcggattctctcaggactatggctccctgagctctaaagccatgagaaagatctttacgtacattaaagaaaacaagtattccgaggcttgccatctcgccgggtacaatcacagcaaaaactccctgaccaaggagcagcttgccaatcgcatcctgaaggaacagctcgagattctgcccaaaaacgctctgcggaatccggtggttgaaaagatccttaaccaaatgattaacctcgtgaatgaggtcatcaaagaatacggaaagcctgacgagatcagaattgagctggcgcgcgaactgaaaaagaacgccgaggaacgggctaatatgacatctgatatcagcaaggccaccctcctgcaccagaaatatgccgaggtgcttcagaaggagttcggcattaaagctccctccagaaacgacatcattcgctacaagctgtatctcgaactggccaataacgggtacaaagatctgtatacaaatcaaaagatcgagaaggaaaacatctttaccgacaaatacgatattgaccatatcattcctcagtctcggttctttgatgacagcttctccaataaggtccttgtgcccagatgtgcgaaccaggataaagacaattatacggctgttgattacatcgagaagaaatacggcgaacggggaaaggaggactttctcaaccgcattcacctggtgttcaagagcaaagaagccatcgccggcaagtctgagtcccagattagctctatgaatacaaaatttctgaagctccagaaaaaggggtccgagatcggagaaggcttcatcgagagagatctgcgggacacccaatatattgctaagaaagccaaggaaatccttttcgggattaccaacagcgtcatctctacaagcggaagaattaccgacaaactgcgcgaggattggaatctcgtgaacacaatgaaggagctgaacctggaaaaataccggaaacttggcctgacggagctcatcgctaattccaaaggggaagagaaggaaagaatcattgactggaccaagcgcaacgatcatagacaccacgccatggacgcgctgacagttgcctttaccacacataatcacatccagtatctcaactacctgaatgctcggaaagatgagaagcataaagagcaccataacattttcgccatcgaaaatattatcaccgagatcgtggaaaagaaaaacggcagcaaggagcgcagatttaaacttcccattaaaaatttccggacggaagctaagaaacagctggaggaggtcctcatctctcacaaggccaaaaacaaggtggtgaccaagaatattaacaaaacaaagaaaaagggaggcgttgtctccaaaatcgtgctgacccctcgcgggcaactgcacaaggaaacaatttatggaagcgcgaagtttcttaaaaccaaggaggagaaaatctccggcaagttcgacctggaaacgattaataaagtgcagaacgaaaagtttaaaaatgccctcctggatagactcaaggagttcaacggggactctaagaaggcttttacaggaaagaatgtcccggccaaaaaccccatctacctgaacgagcagaagaccgaacaggtgcctgagagcgttgtgcttgcttggtatgaaacaggctacaccatccggaaagccgtcaatgccgataacttcaaggactacaagaatctggagaaaattatcgataagggggtgaaagagattctcaagaaccgcctgaatgcttttaacggcaatgcgaaagaagccttctccgacctggagaagaagcccatctggcttaaccaatctaaaggaattgctgttaagaccgtgacaatcacgggcatcaataacgccgaaaccctgcattataaaaaggatcacttcgggaatgagctcctggacgaaaacggcaaaaagattcctgtcgactttgtgagcacaggaaataaccatcacgttgccatctacgaggatgctgacgggaatctccaggagagagtggtctccttctatgaagccgtggagcgggtgaaccagggactgtctattatcgataaggaatacaaccaagaccttggctggaaatttctgttcaccatgaagcagaatgagatgtttctgttccccagcgaagattttaacccgaaagagacagacctcttcgatgagaagaatctgaaccttatttccaaaaatatgtttcgcgtccagaagttcgggagcctgctctctggcttttggttcagacaccatctggaaaccacggttgacctcaactccagcctgaaagatacatcttataaggtgatccagtcctgcaataaccttaagctgatcgtgaaagtccggctgaatcacctcggaaagattgtgcaaatcggcgagtactga

SEQ ID NO: 4469 - RNA, 4236 nt, synthetic construct
  misc_feature 1..4236: note = Cas9 variant
  source 1..4236: mol_type = other RNA
atggtgaagaaagagtacttcatcggcctggacatggggaccagctccgtcggatgggccgttgctgatacaaactataatctcctgagagccaagggcaaagacatgtggggagtgcggctttttcccgaagcgtctacggctgccgatcgcagaagccaccggaccgcccgcagaaacaataagcggaaagctgcccgcgaggggttcctgagagaaatttttgaggacgaaatcaacaagattgatcctggcttctttgagcggctcaaggagtccaaatactatctggaagacaaacttacagataccccgttcgtgctgtttgctgacaaagggtacacagataaggagtattacgacgaatatcccaccgtcttccatctcatcaaagagctgatttctgagaagggactggaacctcacgatatccgcctcgtgtacctggcctgccttaatatctacaagcatagaggccactttctgaacgacacactcagcggcgatgggattgacaatatcaactccctgtgtaatgacttcacctcttatcttgcggattacaaccagaatagcgaggacgatggaacggaaaagatggacctggattccaccgttctcgccggcgtgtttgaggaaacactgtgcaacaagcatctgagcaattctgctaaaaagcgggacctcattgataaactggggatcaccaacaagacaaaatatcttaccgagatgatggccctgatttccggactcgctagctctgtctccaatatgttcgccaaggacacgtacgatgaggaacaaaagaaatttaagctgagcttcagatcttccaaccttgacgaggatatggtgaaagttcaggcgatgctgacacccgaagagtatgaaatgatctgtattatgaagaaaatccacgactggagcgtggtctccgtgatcatgggctctcacaagtacattagcgacgcccgcgtggagctctatgagaagcataaacaggatctggctaagctgaaagccatctacaaggaatacctccctgacaaatatgatgctatgttccgggagatgaccgacaactcctacagcgcctatgtcgggaaggtttcttccaataagaaaagccagacaggaaaccacaaggtgcgcatgcaaagacggggcgccaaatgcaagcaggaagatttttacgacagaattaaaaaggagatcaattctgtgccccaggaagagaagattgatatcctgcaggacatggagaccaacagcttccttcctaaacaactgaccaatgaaaacggcgtcatcccgtatcagctccatctggctgagcttaagaaaattctggataatgcgtccacatacctcccctttctgaactctgccgacgaaacggggatcagcaataaggataaaattatccagctgttcgagtttcgcattccttattacgtgggacccctcttcaagtccgagaaaaacaagaccaatgcttgggttgtgcggaaggaaagcggcaaagtctacccttggaactttaatgagaagatcgacgaaaaacagtctgccgagatcttcattgaaagaatggtgcgccactgtacatatctgaacaatgagtccgcccttcccaagaacagcctgaaatacgagcggtttagagttctcaacgaactgaataacctgcgcatcaatggggagcggatttctccggaacttaagcaaagaatctataacgaactcttcaaggtgaaaaagaaacgcattaccaagtccatgctgtgcgaatacctgtataaaaatggaatcgctgataaggacagcgagctctccggctttgacgggacattcgccaacgcgctgctttcttacggaaagtttcgggagctgttcaatgtcgataccctcacggacaaacaggaagctgccgccgaggatattatcaagtggagcacagtgtatggcgactccaaaaagttcctgcaggagaaaatcgaggaaaactacggccctgagtctgagaatcccctgcttgataacaagcaaattaagagagtcatggggtacaaatttaccgactggggaaatctcagccgcgagttcctgaacctggaaggcgctgataaggacaatgataccacaaccggggaagtgatgcctctcatcacacggatgtgggaggagaactataatctgatggaacttatgtccaacaaatttagctacagagacgccctggctgagaagacggaagagattgagaaaaccctcacagatatcgaatatgaggacctggaagatctgtacatttctgcccccgttaagcggatgacctggcagacacttctcatcctgaaagagatctatcagattatgggatacgcgcccaagaagatcttcgtggaaatggcccgcgaggaagaggagaaagtcaacggcaagggggctagaaaatccagccggaagaaaagactggaagacctctatcgcaattgtaaggacgcctctaaggagctgtccaccggcattaaaaacgctgatgaagccatccttcggagaaagaaactgtacctctactatctgcagaagggaaaatgcatgtacagcggcaagacgattgactttaagtctctgttcaccaataactatgatatcgaccacatctaccctcaaagcgtggttaaagatgactcccttgagaataacatggtgctcgtcgaacgcaattataacaataagaaaagcgatacatttccgattttctctgactggcagaacaagatgaaacccttttggaccatgctgaaggagcaggggttcatcaatgaggaaaagtacaaaagactgacacggaccgatgagctcacggacgatgaactggcgaactttgtgaatcgccagcttgtggagacaagacaagccaccaaggttattgctgagctgctcaaaaactccttcgacgacatcgatagcaagattgtctatgccaaagctggaaatgtgtccgaatttcggcataagttctctatgaagtacgacaaagagacagaaaagagctccgtgatccaccctgagctggtcaaatgtcgcatcattaacgatttccatcacgccaacgactcttacctgaatatcgtggttggcaacatttatgatgtgaagtttacccagaatccctacaactatatcaaagaatacaagaaacagaagaataacagcgccctttccgagcaggagaaggaaaaatatcatatggacaagattttcaattttgatgtcaaaagaaacggggaggtggcttggatctctcggggagacaataagaccctggaaacagttctcaaagtgatgcgcaagaacacgcctattgtcaccagaatgaatttcgaggaacacggccaactggcggatctcacaatctacagcgcctccgacgctctgagcaagaaaggggtgggctatatcaaggttaaagcctctgatgcccggcttgacgtgctgaagtacggaggctacaaaaagtataagggggcttactttttcctcgtcgagcacaccgagaaaaacaagcgcgtgagaacaattgaaaatatgcccctgtatctgaaaaacgagcttaataccaaggagaaaatcgaactgtggtgcgccgataaggaaaacggactcggcctggtggacccggacgtccggctcgggaagattaaactgtactccaagatcagaattgatggatttgacctttatctgacgggccgcacagggaataacctcctgaccagcaacgcggttcagctgaaaatcggctctaataagccttccgataacgacaaacttttctggcggtactatatcaataagctgagcaaatacaccgagaactctgagtttgtgtccattcagaataacatcaagctctacgatctgttcgtggaaattaataacgctggagtctatagcaagagacagaatcccatcggcgacaaactcctggaggggcgctccaagtttattaaccttacactgagcaaacaagtggaaaccctgctcggaatcatccggatttactctctggagaatcagggcgccgatcttagcaacatcgggggacaggagaagaatggcacaatgaaacctcataagagaatttccgacaagaaagaagttctgctcatcaaccaatctgtgacggggctgtatgagagcaagattgatctcctgaaaatctga

SEQ ID NO: 4470 - RNA, 4236 nt, synthetic construct
  misc_feature 1..4236: note = Cas9 variant
  source 1..4236: mol_type = other RNA
atgaagaacatcctgggcctcgacctggggaccaatagcattggatgggcccttatcaaacagaacgctgaggaaagacaaggctccattctggggatgggaacacgggtgctccccatgtctcaggatgtcctgggcgacttcgggaagggaaatagcgtttcccagacggccgcgcgcaccggctacagaggcatccggcgccttagagagcggtttctgctccgcagagaacggctgcaccgcgtgctgaacattctcgggttcctgccttattactatgctgcccagatcgattttgacaaaagattcggaaagtttaaagccgagacagaaccgaaacttccctacaataacgagggcttcatctttaaaaattctttcgaggaaatgctgagcgattttaaaatttcccaacctgagctcctgtctgggaacaagaaagtgccctatgactggaccatctactatcttcggaagaaagctgtcagccagaagattgaaaaggaggagctggcctggatcctcctgaatttcaaccagaaacgcggatactaccagctgagaggcgaagattttgacgaggaaaaggataaaacattcgtgaccctcaatgttgacaaggtgattgattccggggagaaagtcaagggaaacatcctgtttgacatttatttcacaaatggctggaaatacgaaaagcaaaccacgaagcctgaggattggcttggccggagcaaagagttcatcatcaccgaatctctgctcaagaacggggaggtgcgcagaacatttaaagctgttgactccgaaaaggactggattgccatcaaagcgaagaccgagcaggaaattgagacagcccataagaccgtgggaagctatatctacgatgctattctgcagaatcccaaacagaagatcaaaggcaaacttgtccggacgatcgagagaaagttctataaggaggagctgcgcaagattctcgaaaaacaaaaggactttcacctggagctgcagaacgaagatctctactctgactgcgtgcgggagctgtatagaaacaatgatacacatcagctttccctggccaaaaagagcttcatccacctctttctggaggacattatcttctaccaacgccctcttaaatctcagaagtccagcgtgtccaactgtaccctggaatgccggaagtacagagataaaaatggggctgagggcattcagtttctcaaggtcatcccgaaatctaacccctattaccaggagttccgcatctggcaatggatgagcaatctgaagatttatcggagagacgatgacgttaacatcacatccgaatgtctgaaaaccgccgaggattacgaagacctctttgtgttcctgaatattcgcaaggaggtggaccagaaagcgtgccttcggcattttaagctgagcgaaaagacccacagatggaactatgtcgaggataaaaagtacccttgtaatgaaacaggaacgatgatctctgagcgcctcaaaaaggtgggggactcccccgataacattttcacccgggagatggaacagcagatctggcacattatctatagcgttaatgacaaaacagagtacgaaaaggccctgaagtcttttgctaaaaagaacgagctggataatgacagcttcttcgaagcctttagaaaattccctccctttgattccgagtacggatctttcagcgagaaggctatcaaaaagctccttccgctgatgcggattggcaagcattggaactgggaagccgtggacgagaaaatcaagaatcgcattcaaaagatcattatcggcgaatatgatgagaacatcaaggacaacattagagaaaagaccctgtccctccagaaggagagcgattttcaggggctgcctctttggctggcccagtacgtcgtgtatggacggcactctgaggcttccgttgcgggcaagtggaatagcgtggacgatatcgaagagtacctcaaagagttcaagcaacattctctgagaaaccccattgtcgaacaggtgatcatggaaacagtccgcgtggttaaagacatttggatcaagtatgggaatggagccgctgactttttcgatgaaatccacattgagctgggccgggaaatgaaacttcctgccaaggagagaaacaaaatgacccagaagatctccgaaaatgagaacacgaatctccgcattaaggccctgctggctgagatgatgaacgacagcgaagtgcagaatgtcagaccctactcccccatgcaacaggagatcctcaaaatttatgaagatggggccctgaactctgagatcagcgtggacgatgacatccttaagatttccaaaacagcgcagccttctccgagcgatctgaagaaatacaagctctggctggaacaaaagtaccggtccccctataccggcgacatcattcctctgaataaactttttaccacagagtacgagatcgaacacattatcccccagagccgctatttcgatgactctttttccaacaaggttatttgcgagagcctcgtgaatagactgaaagataactacatcggactgggcttcatcaagcagtttcatgggtataaaatttctgacaagaccaaggtcttcgaagtggaggaatacgaggatttcgtgaaaaagaattatgctaacaaccggtccaaacgcagcaagctcctgcttgaggaaatccctgaggaaatgattgagagacagctgaatgacacacggtacatctctaaatacattagcggaatcctctccaacatcgttcgcaagaaggagaatgacgaaggcgtcaacagcaaagatattatccccgggaatggaaagattacgtctcaactgaaacaggactggggcctgaacgatgtgtggaatgaccttatcctcccgagatttgagcggatgaacgaactgaccaagtccagctatttcacagtgtggaatgagaaataccagaagtttctgcctaccgtccccgtggagttctccaaggggttttctaaaaagcgcattgatcacagacatcacgccctcgacgccctggttatcgcttgtgccacaaaagatcatgtgaaccttctgaataacaagagcgctaaatccgaaatgaagcggtatgacctcaaaagaaagctgatgaagttcgagaaaaagacctaccagcactctcaaacgggcgaacgcatcgtcaaagatgtgcctgttgagtttctgaagccctggaatgacttcaccgtggaagccaaagagaaccttgaaaagattatcgtcagctttaagcagaatctgcgggtgattaacaaagcgacaaaccactatgagaagtggatcgagaaagataatgttaaggtgaaaggactcgtcgaacagcagggcctgaactgggccattagaaagcctctccataaggacaccgtgtccgggaaagtggacctgcccggaatcaaggtcccgaaaggcaagattcttacagctacccgcaaatctatcgatacgagcttcgacctgaagacaatcaattccattaccgatacaggggttcaaaagatcctcaaaaactacctggagtataagggaaatagctctgaagaggccttttccagcgaaggcattgaggacatgaacaataacatcgagaaattcaatgaagggaagctgcaccagcctattaccaaagtgcggatcttcgagcttggctctaagtttcccctgggacagatcggcaacaaaaagcataagtacgtggaaaccgctaaagggacaaatctcttctttgccatttacgaggatgacaagggaaaaagaacgtatgagaccatccccctgaacgaagtcattgagcgccaaaagcagggcctcgcgcctgtgacactgaaatccaagaatgatttctacctttgcccgaacgacctggtttatgtggccgctgaaggggagagcgtcaataagatcgattttaaatacgcctctcaggaatttattcacaacatctataaggtggtttccttcagcggatcccagatcttctttgtgaaacaaaatattgctgtcagcatcgtgaacaaggccgagttctctaccctcaacaaaatggagcgggccgttgacggcaagatgattaaggattgttgcatcaaactgaagattgacagaatcgggaatattacaaaaagctga

SEQ ID NO: 4471 - RNA, 4239 nt, synthetic construct
  misc_feature 1..4239: note = Cas9 variant
  source 1..4239: mol_type = other RNA
atgatgaccaagaacatcctgggcctcgacctggggacaaatagcattggatgggcccttatcaaacagaacgctgaggaaagaaagggctccattctggggatgggaacgcgggtgctccccatgtctcaagatgccctgggcgacttcgggaaaggaaatagcgtctcccagaccgcggctcgcacaggctacagaggcgttcggcgccttagagagcggtttctgctccgcagagaacggctgcaccgcgtgctgaacatcctcgggttcctgcctgattattacgccgcccagattgactttgataagagattcggaaaatttaaggctgagaccgaaccgaaacttccctataataacgagggcttcatctttaaaaattctttcgaggaaatgctgagcgactttaagatctcccagcctgagctcctgtctgaaaacaaaaagattccctacgattggacaatctattaccttcggaaaaaggccgtgagccaacgcattgagaaggaggaactggtctggatcctcctgaatttcaaccagaaaagagggtattaccagctgcggggagaggactttgatgaagagaaggacaaaaccttcgtgacactcaatgttgataaggtgattgactccggcgaaaaagtcaaggggatcgtgctgtttgatgtttacttcaccaacggatggaaatatgagaagcagattacgaagcctgaggactggcttggccgcagcaaagaatttatcatcaccgagtctctgctcaagaatggcgaagtgaaaagaacatttaaggctgtcgactccgagaaagattggattgccatcaaggcgaagaccgaacaagagattgagatcgcccataaaacagtggggagctacatttatgacgctatcctgcagaaccccaagcagaaaatcaagggaaaacttattcggaccatcgaaagaaagttctacaaggaggaactgcgcaaaattctcgagaagcagaaagaatttcaccctgagctgcaaaatgaggatctgtattctgactgcgtgcgggaactctacagaaacaacgatgcccatcagctgtcccttgctaagaaagacttcatccacctgtttgtcgaggatattatcttctatcagcgcccgctcaagagccaaaagtcttccgttagcaattgtacgctggaatgccggaaatacaaggacaaaaacggcgaggagagaatccagtttcttaaggtgattcccaaatccaatccttactatcaggagttccgcatctggcagtggatgtctaacctgaagatttaccggagagatgacgatgtgaatatcacaagcgagtatctcaaaaccacagaagactaccaagacctgtttgtcttcctgaacacccgcaaggaggtggatcagaaggcctgtctcaaacattttaagctgaatgaaaagacccaccggtggaactatgttgaggacaagagatacccctgcaatgagacagggacgatgattcttgaacgcttcaaaaaggtgggagattccgcggacaacatctttacccgggagatggaacagcagatgtggcacattatctatagcgtcaatgataagacagagtacgaaaaagccctgaagtctttcgctaaaaagaacgacctcgataatgtgtccttctttgaggccttcagaaaatttcctcccttcgacagcgagtacggctcttttagcgaaaaggctatcaagaaactgctgccgcttattcggaccgggaagtattggaactgggaggccgttgatgaaaagacaaagaaacgcatccaaaagatgattaccggagagtgggacgaagatatcaaggacaatattagagagaaaacgctctccctgcagaaggagtctgatttccagggcctgcctctctggctggcccagtacgctgtgtatggccggcatagcgaagcgtccgtcgccgggaaatggaacagcgtgaacgacatggaggaataccttaaggagtttaaacaacactctctgagaaatcccatcgtcgaacaggtgatcacagaaaccattcgcgttgtgaaggacatctggattaaatatggaaacggcgctgccgatttctttaatgagatccatattgaactcgggcgggagatgaagctgcctgccaaggaaagatccaaaatgacccagaagatcagcgagaacgagaatacaaacctgcgcatcaaagcccttctcgtcgaaatgatgaatgactctgaggtgcacaacgttagaccctactcccccatgcagcaagaaattctgaagatctatgaggatggagctctgaatagcgaaatttccgtggacgatgacatcctcaaaatttctaagaccgcgcagcctagcccgtccgatctgaagaaatacaaactttggctggagcagaaataccggtctccctatacaggcgacatcatccctctcaacaagctgttcacgaccgagtacgaaattgagcacatcattccccaaagccgctattttgatgactccttcagcaataaagtcatctgtgaatcttccgtgaacagactgaaggataattacattgggcttggctttatcaagcagttccatggatataaaattagcgacaagacaaaagtgttcgaggttgaagagtacgaggattttgtcaagaaaaactatgcttctaattggtccaagcggagcaagctcctgctggaagagatccctgaagagatgatcgagcgccagctcaacgacaccagatacatttctaaatacatcagcggcattctgtccaacatcgtgcggaagaaagaaaatgacgatggggtgaacagcaaggacattatccccggaaatggcaaaatcacatctcagcttaagcaagattgggggctgaacgacgtctggaatgatctcgtgctgccgcgcttcgagagaatgaacgaactgaccaagtccaatgactttacggtttggaacgagaaatatcagaagttccttcctaccgtgcccgtcgaatttagcaaaggattctccaagaaacggattgatcaccgccatcacgccctcgacgccctggtgatcgcttgcgccacaagagatcatgttaatctgctcaacaatcagtctgctcggagcgagatgaagagatacgacctgaaacgcaaacttatgaagtttgagaagaaggcctatcagcactcccaaaccggcgaacggattgtgaaagatgtccctgtggagttcctgaagccctgggacaactttatcgttgaagcgaaagagaatctcgacagaattatcgtgtctttcaagcagaacctgcgcgtcatcaataaggccacaaaccactacgaaaaatggattgagaagaacaatgtgaaagtgaaggctctggtcgagcagcaggggcttaactgggccatccggaaacctctgcataaggataccgttagcggcaaggtggacctccccggaacgaaagtgccgaagggcaaaattctgacagctaccagaaagtccatcgatacatcttttgacatgaaaaccattaatagcatcaccgatacagggattcaaaagatcctcaagaactatctggaatacaaaggatcctatgaggacgccttcagccctgaaggcatcgaggatatgaataagaacattgaaaaattcaatgacgggaagcagcaccagcccatcattaaagtccgcatctttgagcttggatctaagttccccctgggccaaattgggaacaaaaagcataagtacgtggagacggcgaaaggcaccaatctctttttcgccatctacgaagatgacaagggaaaacggacatatgagaccatccctctgaacgaagttattgagagacagaagcagggcctggctccggtgacatttaaatccaagaatgatttctaccttagccccaacgacctggtctatgtggccgctgagggggaatctgttgataatctcgactttcagtccgacagccaagagtacatcaacaatgtgtataaggtcgtgtctttctccggaagccagattttcttcgttaaacagaacgtggccgtctccatcgtgaataaggccgaatttagcaccctgaacaaaatggagcgcgctattgatggccggatgatcaaggaatgttgcgtgaaactcaagatcgacagaattgggaacatgacgaagtcttga

SEQ ID NO: 4472 - RNA, 4245 nt, synthetic construct
  misc_feature 1..4245: note = Cas9 variant
  source 1..4245: mol_type = other RNA
atgaagaaaatcctgggcctcgacctggggaccaacagcattggatgggccttcgtggaggaagctgagaatgaatccgagaagtctagcatcattaaacttggcgtcagagttaaccccctgacagtggatgaacagcaaaattttgagaaggggaaatccatcacgaccaacgccgaccggacactcaagcgctctatgagacggaatctgcagcgctacaagcagagacgggagaaccttattgatatcctgatgaaaaatggattcaccagcgacgatacaatcctctccgaaaacggcaatcgcaccacatttgagacctatagactgcggtctaaggcggtggctgaaaagattagcctgcaggagttcgcccgcgtcctcctgatgatcaacaagaaaagagggtacaagtccagccggaaggccaaaggaacggaggacggcgaacttattgatggcatggaggtggctaagaaactgtataattacaacctcacccctgggcaactgtgccttcagctgctcaatgaaggaaagaaacatctgccggacttttatcgctctgatctgcaggccgagttcgacagaatctttgatattcagatgacattctacaccgaatatctcacactggagcttaaggaggaactgcggggcaaaaagcgcgacgctgtttgggccatctgtgcgaagatttttaaagagaaggggttcgaactcatcggaaccaaaagacaaggctccacggccgagcagaagcacgaaaactacagctggcgggctaaagggctgtctgagaaacttgagctggaacagctcgtggtcgtgctgcagcaaatcaatattcagctgaactccagctctggatacctcggcgccatctccgatagaagcaaggagctgtttttcaacaaacagacagttggccaatatcagatggctgtgcttgacaagaatcccaacgccgggctgcgcaatatggtcttttaccggcaggactatctcgatgagttcaacgcgatttgggaaaaacaggccctgttccaccctatccttaccgacacactgaaggatgaaattagagacgtgatcatcttttaccaacgccggctcaaatcccagaagggactgatttctttctgcgagctggagagcagaaagatcgaagtggagattgctggccagaataaaaccaagatggtcgggtcccgcgttatcccccggagctctcctctctttcaggagttcaaaatttggcaatccctgaacaatatcgaagtgtttggaaagggcaaaaagagcaagaaacagaaggagcagacccttttcgatcagacagaagaccccctggagtttgggggaagacgcgaactctatgaggaagagaaagagctgctggcccttgaactctctatcaagaaagagctgaagaaagctgatattctgaagctcctgttcgacaaccctaaggaacttgatctgaattttaacgccgtgcaaggcaatctcacgcaggccaccctgttcaacgtctacaaaaagatcattgagctgagcggccatgaaatcgacgtggagaaagattccgcttctaagattcttaaaagcatcgaggaaatttttaaggcgctcaattataacacagagatcctgcacttcgactccgaaaagagccaggaccagcaagccatgtacatgctgtggcatctcctgtactcttttgagggggataattccaacaccggaaacgaaaatcttatcaacaaaattagcaagctgtatggcttcgagaaagagtacgctaagatcctcgccaatgtttctttccaggacgattatgggtccctgagcgccaaagctatttccaagatcctgccgtaccttaaggaaggacacaaatctgacattgcctgtgatctcgcgggctataagcacagcgcttcctctctgacacgggaggaactggagaacaaaacctacaaggacagactcgagatcctgcccaaaaatacgcttcgcaaccctgtggtcgaaaagatcctgaatcagatgattaacgtgatcaatctcattatcgatagccgggagctgaagaaatccgccaaggaaagagaggaactgacaaaaagcatttctgagaccaccaaacttcatcaacagtataaagacatcctcgccaaggctccctttaacctgacaaatacctcccggaacgatatcattcgctacaaactgtacgaggaactcaaggacaatgggtataagacactgtacagcaacaaatatatctctcctgccgctcttttctccggcgattttgacattgagcacatcattccccagagcagactgttcgatgactcttttagcaataagacgctcgaactgcggtccatcaacatcgagaaaggaaacaagaccgcctacgacttcattaaaggcaagtatggggaaacaggagaggataattgcctggacaagtaccttaacagaatcgagaccctgtataaaaatggcattctcaagaaaagcaagtacaacaaactgaagatgcaggataaggacatcccggatgggtttattgaacgcgacatccgggatacacaatacattgcgaaatatgccaagaccctcctgggagaccttgttaaattcgtggtctctacgtccggcagcgtgaccgagagactgcgcgaagattggcagctcgtcgacgtgatgaaggagctgaattgggaaaaatacatgcagctggggcttacagaggagtttaccaacgaagagggccatagaatccggaagatcaaggattggacaaaacgcaatgaccacagacaccatgctatggatgccctgaccgttgctttcacgaagcggcagtttattcaatatctcaacaatctgaacgcccgcagaatctccgacgaacagggaatttctaatagcgagaaagacgagcggaacaatgtgtccatcacaaccaacgatatgaagctcaatacacgcgacgtcctgggcattgaaaagaaggagctttacagagataaccgggggaagctgcgcttcaaagcgcctatgcccctcctggaatttagagaggaagccaagcggcacctggagaacacccttatctctatcaaagctaagaataaagtgaccacaattaacatcaatacgctgaagaaagccggaggcgtttataagaagacccagctcacacctagagggcagctgcataacgagaccatttacggaagccaaaaacagtatatcgtgaaggaagagacaattaatgctaaattcgacgtcgaaaagatcgccaccgtgacgaaccccgtgtaccgcgaggccctcctgaaacggcttgaacagaataacaatgatcccaagaaggctttcacaggctccaacgcgctgaccaaaaagcctatgtggtttgacgagcaacagaccgagaaagttccggaaaaggtcaaaacagtgtctttcgagaccatctacacaattagaaaggaaatcagccccgatctgaagattgagaaagtggtcgacgaaaaggtgcgccagatcctcaataaccggctgaatgagtataacgggaatgccaaacaggctttttccaaccttgatgagaatcctatttggctgaacaaggaaaaaggcatcacgattaagagagttaccatcacaggaatcaacaatgcccaagccctccacgagaagctggacaaagatggcaagcccattctcgacggggaaggcaaaaagcagcctgtggacttcgtcaacaccggaaataaccatcacgtggctgtttactgtgatgccgacgggaatctgcaggagaacgtgatcagcttttatgaggcggtcacacgccggaatcttggactgcccattatcgataaagactacaagaaagatgacggctggcagttcctgttttctatgaagcaaaacgaatatttcgtgtttccgaatgagtccaccgggttcaaccctaatgaagttgatctcctgaaccccgacaattacagccttatttctcctaacctgtttagagtgcagaagttcacgatcaaagattatttctttcgccaccatctcgagaccaatgtcgaatccaacagcacactgaagggcatcacctggctccggtgcggactgaacaatattgacaacatcattaaagtgagaatcaatcacattggccagatcatccatgtgggggagtactga

SEQ ID NO: 4473 - RNA, 4248 nt, synthetic construct
  misc_feature 1..4248: note = Cas9 variant
  source 1..4248: mol_type = other RNA
atggccaagttcaacaaaccctacagcatcggcctggacattggggtgtcctctgtcggatatgctgttatcaccgaggattacagagtgcctgcctttcggttcaaggtgctcggcaatacagaaaaagagaagattaaaaagaacctgatcgggagcacgacctttgtcccggcgcagtccgctcaagtgacacgcgttttcagagtgaatcggcgcagaattgaccggcgcaaccacagaatcgcctatcttcgggatatctttcagaaggaaattgagaaagtcgacaagaatttctaccgcagactggatgaatcttttcgggtgctcggagacaaaagcgaggatctgcagatcaagcagcccttctttggcgacaaagagcttgaaaccgcctatcataagaagtaccctacaatttatcatctgcgcaaacacctcgctgatgccgacaagaactcccccgttgctgatatcagagaggtgtacatggccctgtctcacattctgaaataccgggggcatttcctcaccctggacaagatcaatcctaacaatattaacatgcaaaatagctggatcaactttatcgaatcctgccaggaggtcttcgatcttgaggtgagcgaagagtctaaaacaattgcggccatctttaagtccagcgaaaatcgccaggagaaagtgaagcagattctgtcttatttccaacaggaactcctgaagaaagacaagtccatcttcaaacagcttctgcagctcctgtttggactgaagaccaaattcaaggactgttttgagctcgaggaggaacccgatctgaacttcagcaaggaaaattacgacgagaaccttgaaaacctgctcggcacgctggaggaggatttttctgacgtcttcgctaaacttaagattctgagagataccatcctcctgtccgacatgctgacatataccggcgccacacacgctcggtttagcgccaccatggttgaaagatacgaggaacaccgcaaagatctccaacggttcaagtcctttgtgaaacagaatctgtctgagcaggactatcttgatatcttcgggagaaagacgcctaacggatttgacgtggataaggaaacaaaaggctacgtcgggtatattagcaataagatggtgctgaccaacaaacaaaagacaatccagcagaatttctacgactacatttccggaaaaatcaccggcattgagggggcggagtattttctcaacaagatcagcgacggaaccttcctgcgcaagctgcggacaacggataatggcgccatcccgaaccagattcatgcttacgaactggagaaaatcattgaaagacaaggccgcgactatcccttcctcctggagaataaggataaactgctctctatcctgacctttaagattccttactatgttgggccccttgccaaaggaaacaattcccggttcgcttggatcaagagagccacaagccaggacattctggatgacaacgatgaggacacccgcaatggcaaaatccggccttggaactaccacaagctcatcaatatggataagacaagagacgcctttattaccaacctgatcgggaacgatattatcctgcttaatgaaaaagtgctccccaagcgctctctgatttatgaggaagtcatgctgcagaacgagctcacgcgggtgaaatacaaggacaaatacggaaagacacatttctttgatagcgaactgagacaggagatcatcaataaccttttcaagaccaattccaaacgggtttctagcgctatgctgctcaactatctggagaattacaccaacctgcaagcggtggaaattgtctccggcatcgagaaggggaaaagccttaattctacactcaagacctataacgacctgaaaacaatcttttccgaggaactgctcgacagcgaaatttaccagaaggagctggaggaaattgtgaaggtcatcacggtgttcgatgacaaaaagtctatcaaaaattatcttaccaagtactttggacgcctggagttcctcaacgaagagagaattaatcagctgtccaaactgcggtatacaggctggggcagatacagcgccaaacttctcctggatatccgcgacgaagataccgggtttaacctgatgcagttcctccggaatgacgatgagaacagaaacctgtcccaacttatttctgacagcacactgtcctttgattctgctatcaagagcattcagtccaagagcaccgttgaggacgatgtgttcgacgaaatcaagaaactcgccggatctccggccatcaagcgcggcattcttaattccatcaaaattgtcgatgagctggtgcagatcattgggtaccctccccagaacatcgttattgaaatggctagagagaatatgacgaccgaggaaggacaaaagaaagccaagacacggaagaccaaacttgagagcgcgctcaagaacatcgaaaattctgtgctggagaacggcaaagtccctcactccgacgaacagctgcagagcgagaagctctatctgtactatcttcaaaatgggaaagacatgtactctctggataagacaggcagccccacgcccctctatcgcgacagactggatcagtacgaggtggaccacatcattccttattccttcctgccgatcgatagcattgacaacaaggtgcttacccatcgggaaaataaccagcgcaaactgaataacatccccgataaggagacagttgctaatatgaaacctttttgggaaaagctctacaacgccaaactgatttctcagaccaagtaccaaagactcacaacctccgagcggacccccgacggagtcctgacagaaagcatgaaggccggcttcatcgagcgccagcttgtggagacgagacagatcattaaacacgtggctcggatcctggataatcgctttctcgacaccaagattatcacactgaaatcccagctgattaccaacttcagaaacacatttcatatcgccaagatccgggaacttaatgattatcaccatgctcacgacgcctacctggcggtcgtgattgggcaaaccctcctgaaagcctatcctaagctcgctcccgagctgatctacggacaccatgcccacttcaacagacatgaagagaataaggctacgattcgcaaacacctttattctaacatcatgcggtttttcaataacccgaatagcaaggtttccaaagacatttggaactgcaatagagatctgcctatcattaaggacatcatctacaactctcaggtgaattttgtcaaacgcacaatgattaagaagggcgccttctataaacagaacatcattcccaatgatagctccgtgaccgttgacaagcggtttcctatcaaaaacaagaaatacctcgatcccaagctgtacgggggatattacgaaagaaattctgcgctgagcgtgttcattatcggccagtccttcaacaaaaataacaaacttaaggtcgtgaaggagttttatgacatcaacattatcgattaccctctgttcaataccgaccccatgagctttttcaacgatgactctgagaatgggtttctcacaaagaacaatctgcaatccgttcaggccttctataaaattccgaagtacagcctcatccagaaaaacgatggcacccgcatgctgtttgaatctacaacgaatttccacaaggctacccaatttaaacttacagaggcccagaacgaactgttctttcatatgaagcggctgctcaccaagacagacttcatggatctgaaatccgaggagagcattaaggaatctcaggactttatcatgaatcacaaaaacgagttcgacaatatcgtgaacggacttttcggctatgctgaaagacagctggggtccaagagcctctttacccaagcccatgaggcctacaagctgcgcaaataccctgtcttctccctcaatgaagagacgattcggtattactatgataactttctgagacttttcagcctgaccaagtctggaacaagctccggctacgtggtggggctgtttgaggctcccaaactccggaatgtcgtttatcgcgcgaccaaggacgaatctaacgccacactgatccaccagagcattaccggactttacgagacaagaatcgatctgtccaaactcggcgaagactga

SEQ ID NO: 4474 - RNA, 4248 nt, synthetic construct
  misc_feature 1..4248: note = Cas9 variant
  source 1..4248: mol_type = other RNA
atgaacctgagaaatgtggccaaggagggcatcaactacaatattgggctcgacctgggaaccggcagcgtcgggtgggctgttacagatgaacagggagagcttttctcctttaaaggcaagacgacctgggggtctcggatcttccccacagccgaaaccgcggctgacacacgcctgaaaagaggacaacggcgcagatatgcccggcgcagatggcggctcgatctgcttcagagcctgtttgaggaagagattaagaaagtggaccctgagttctttacccgcctcagacagtcccatctgctgaaggaagataagacatacgccgctatcctctctagcaaaggcgccacccggccgctgttccccgagggcgaagctgaggtggagtattacaagaaatatcctacgatttaccaccttcgcaaggccctgatggaatccaacaatcaggaggacatcagactcatctatctggcgtttcacaacattgtcaaagcccgggggaatttccttcatcaagatacccccggactgacagcttctaacgccaatatgggcgacgctgtggaaaagctctgcagcgccctggaggattggtgttccagccagaacatcgaatgcgcgattcgcaagaatcagaaatctatccaggacctgatggaggggaagaccattgagccttccgaaagcaacgccctcaaagagacatttgatgcttctagatccagccggaaggacaaagcctctgttctggctggatggatcgccattcaacccggcgaacagttcgagcctaagcaggccaaagatgcttccaaggaaatcgcgaatgccgtgtttgggcttagcgctaacatgaagaaagtcttcgtggagctggaggaagaccagaagatctacctcaataacgacgagcaagttgaagccttttacaccgtgtgtccggatgagggagtcgccctgttcgaagcccttcagtccatgtattctgcttacgtgctgatgggcattctcaaaggcgcggacgggggaagcatctccagctgcaaggtggctgcctatgagcagtacaaagaggatctgaagctgctcaagacgctggtcagagagttcgcccccaaaaagtatgacgagtttttccgcggcgatatttttgacgctaaaaaggggttccggacaagaaactacgatcctgccaccgctaaaggatatacaaagtacaattctgttcgcggcgcctcctacgacgcgtttaagaaagaagtggagaaacttttcgaggggaccgccgctgaagaggatgtgcggtataccgacatgatgcaaagatttgatgaaggaacattcctgcgccggctcaagacgagcgacaacggctctatcccctaccagctgcaccttgaggaaatggtcgccattatcgagaatcagaagaccttttatcctttcctggaggaaaacaaagagaagtttgaaagcctcgtgacattcagaatcccctactatgttggcccgctgacccagaagaatgctcgccctgacaaccatgggaatgcccggtttgcgtggtcccaaagaaaagagggacaggaaaacgcccgcgtgtacccctggaattgggaggaggtcattgatcggaagcagtctgctgccaaattcatggaaagactgacaggcacctgtacgtatatcctcgaggaacctgtgctgccccggtacagccttctgtacgaggaatattgcctcctgaacgagctgaatggggctcgctggagagacatgggaggcgattggcaccggttcgactacgagacaagaatggatattatcgaagacctttttaagaaaaagaaagggaccgttaagtatgccaccgtggccgattggctcgtccgcgagaagcaccggtcctgtgctgaagtgaaaggcggacagggcgagacagggttcgagagcaagctgtcttcctacgtctttttcaaaggagtgctgcatgttgacgaaattgatgaggcggacatccccatgatcgaagaactcatttggtggaacaccctgtttgaagatagaagcatccttaaggagtctattgaggacaaatatggcgatcgcctgaatgacgaacaaatcaaggccatttgcaagaaaagattcacagggtggggacggctctccaagaaactgctgtgtggcatcaaggctcagacggacaacgggccttgcagcattatggatgtgcttcgcgagggcaatccgaacaacgacgccagatccgccaccatggtctttatggaaatcatccgggatgacaaattcggatttacaaagctcattgaggaagagaataagaaacgcatctctagcgtggatgacttcgatgttaacgacctgcccggctcccctgctgtgagacggaccgtcaatcaggccaagcgcattgtggatgagatcgtggggattgcgggatgtgctccccagaacatctttatcgaagttacaagagacgaggatggccggaataaagggcgcagaaccaagcggagatacgacgccattcaagaagccgtcaaagtgctgaagaaggagcagaaagaatatttcgatgctaacgtggccgacctcctgaagaatacggcgcctgctgcccttgacgatgagcgcctggccctctactttatgcagaacggaaaatgcatgtactgcggcaaggacctggatatcaatcagctggacaaatatcaagtcgatcacattcttccccagtcttacgtgaaggacgatagcttcgagaacaaagctctcgttcattccgacgataatcagagaaagagcaactctatgctgctggacgattccatcattcggaagatgaaaccgtattgggaagccctccgcagcgctgggctgatcggcgagaagaaattcaagaatcttacccgggtgagagtctctgacaaagaactgggaggctttatcgcccgccaaatggtggagacatcccagagcatgaagctcacctctctgctgcttgagcaggcgtaccctgaaacacaggttcggcccgtgaaggccgggttcagctccgacctcagacgccggctgaaactggtcaagtgtagagagattaacgattatcaccacgctcatgacgcctacctcgcttgcgaagtgggacaatttatcgccctgcggcacaataaactttatgagaaccctattggctacagccatgccgttaaggatttcatcgctaaacgcgcgaagtacgcctctgaacacgggaagcccatggacacctatggaatgcctggctccagctcctttgtgatttctagcttcatgacgtccgggtttgatgaggagacaggcgaaatcttcaaagacgcttgggatgcctctctggccgctgtcagaatccatcaggccctcaaccggaaggactgttacattagccgcatgcccgaggaaacctccggagcgttttgggatgctacaatctattctccgaaacagaccaagaaaaagctgagcctgcctcttaagaaaggcctggacccccagaagtacgggtcctatagcagagagcaattcgcctactttttcgtgtatgaagccaaaaagattaaaaagaaggaggagaccaaagaatacgtgttcgcttctgtccccgttcaggtggccgcgctcgtggctgccgatcctaatgccctgatcgagtttgctaaggccgacgctgaggaacggggactcaaattcgccaagattgtcagagaaaaagtgtacaagtatcagctgatcgaggttaacgatgagcgctttttcgtgacaggccttcggacggtcagaaatgggctgcagattgcgttttccgaacaagaccgcaacatcgtgagcggaatcgttgagggcaattcttccaacaataacctcctggacatttacgataaaatcaccaatcggtatgccctgtacgctagcagattcggcaaacttctgaacctctctgggtatcgcgaaaattttattcaggcctccctggaggaccaggagcgggtggtcctcgctctgatcagccttttcaacgccagaacaaatatgattgatctgtccgccatcggaagctctaagaccgtgggcaacatgagcatgacatttgctaaggaaatggcgatggccgacaatcgcttcgcttttatcgatcaatccgttaccgggatgctcgagagaaagacgtacctgtga

SEQ ID NO: 4475 - RNA, 4251 nt, synthetic construct
  misc_feature 1..4251: note = Cas9 variant
  source 1..4251: mol_type = other RNA
atgggcagcagaatcattcccatgtcccaggacatcctgggggagttcggaaagggcaactctgtgagccaaacctccgaacggacagcctaccgctctacgagacggctccgcgagagatttctgcttcggcgcgaaagactgcaccgggtcctcaatattctggatttccttcctacccattatgctagccagatcgactttaaaaagcgcctggggaaattcaaggagaacaaagaaccgaagattgcctacgataataagtcctttctcttcctggactcttttaacgagatgctgaaagatttcgagcaggaacagcccaatatgctcatcaacgagaagggagaaaagaagctgatcccttatgactggacactttactatctgcggaaaaaggcgctcagagagaagattagcaaagaggaactgtcctggatcattcttaattttaaccaaaagcgcggctactatcagctgagaggggaggatgaagaggaaaatcccagcaaactcgttgagttccactctctgaccgtggtggacgtcgtgcctgatgagcccatcaagggaaaactggaaacatggtactccattatcctcgacaacggctgggtttaccggcgcagctctaagaccgagctgtatgattggaaagacaagattaaggaatttatcgtgacaaccgatcttaattacgacggcacggtcaaaaccgacaaggaggggaacgtgaaaagatccttccgggctcctagcgaaacagattggaccctgatcaagaaaaagacagagtatgagattgaacagtcttccaagaccatcggagagtacatttataatacgctcctgaaatacccggaacagaagatcagaggcaaacttattcgcacaatcgagcggaagtattacaaagaggaactgaagcaaatcctcctgaagcagaccgagtttcataacgaactgaaagacgatagcctctactatgactgcctgagagagctttaccgcaataacgaatcccaccagctgttcctcgagaagaaaaacttcgcccagctgtttattgaggatatcattttctatcaacggccccttagatctcaaaagagcctgatctccaattgtcctctcgaattttacaaattcaaggacagcgttgggaacgagaaggtgcagcatctgaaagccattcccaagtctaatcctttttatcaggagttccgcatctggcagtggatctccaacctgagcatttactctaaactcgatgacagcaattttacatcccacttctttgattctaccgacgattgggaaagcctgttcgaaatgcttaacggacggaaggagatcgagcagaaacagctgctcaagtttctgctggagaaaaagggcttcaaggggaaatcccttagctctgaaattgaaaagtatagatggaattacgtcgaggacaaaaagtacccctgcaacgaaacccgctccctcatccaaagccggctggacaaagtggctaatctgccggagtcttttctcacaagacacgtggagcaggaactgtggcatcttatttattccgtcacggataagatcgagttcgaaaaggccctggacaccttcagcaaaaagtacaaaattgatacacctacctttgttgacgctttcaagaaatgtcccccttttaagtccgagtatggatctttcagcgaaaaggccatcaaaaagctcctgcccctgatgcgcacaggcaaatactgggatcttgacaacatcgataaggcgaccaaacagcggattgagaagatcatttccggcgagtatgacaaggatatcagagaccgggtgcgcgaaaaagccattaatctcctgtctgagacggattttaacagactgcagctctggctggctcaatacatcgtgtatgaccggcacagcgaagccacatcccttgataagtgggagaccatcgacgacattgtcacctacctgcatagcttcaaacagcactctctcagaaatcccatcgtggagcaggttattacagaaaccatccgcgtggtcaaggatatttggtccaactacgggaatggaagcaaagactattttaacgagatccacgtggaactgggccgggagatgaagctgcctgctgaagagagaaaacgcatccaggagaagaactctcaaaatgaagatacaaaccttagaattaaggccctcctgtccgagatgcagaatgacccgaacgttgaaaatgtgcggccctacagccctgtccagcaggagatcctgaaaatttatgaagagggggtgctcaactctaatatcgagattgcggatgacatcctgaagatcagcaaaacggcccaaccctccagctctgatcttaagcgctacaaactgtggctcgaacagaagtatcagtccccttacaccggagagattatccccctgaacaagctgttcacaccggaatatgagattgaacatatcattcctcaaagcagatactttgacgattcctacaataacaaagtcatctgcgagtctgctgtgaataaacttaaagacaacagcctcggctatgagttcattaaggggtacaatggacagatcgttgaatgtggctttggcaaaaaggtgaagatcttctccattgatgagtatgaagactttgtccagaaaaactacgccaataaccggtctaaggctagccgcctgatgatggccgatatccccgagaaaatgattgagagacagctgaacgacacccggtatatctccaagtacatttctaatatcctcagcaacatcgtgcgctccgaaagcaatgacgatggggttaactctaaaaatctgatttccgtgaacggaaagatcacaaccgtccttaagaaagactggggcatgaatgatatttggaacgacctgatcctccctagattcattcggatgaatcaaatcacggatagcgactctttcaccacatggaacgagcgctttcagaagttcatccccaccgtgcctattgaactgtccaaaaattttagcgccaagagaatcgatcaccggcatcacgctatggacgcgctggtgattgcctgcgctacaagagatcatgttaaccttctgaataacctctatgccaaatcttccgcccgctacgacctgaatcggaagctcagaatcttcgagaagaccacgtacaaagatattaagacagggcagatcattgaacgcgagatccccaaggcttttctgaagccgtggcagaacttcaccacagacgccaaagacgcgatcgagagcattatcgtctcctataagcaaagccttcgggtgattaacaaatctaccaattactatcagaagtgggtggaaaaggatggaatcgtcaaaaaggagaaaattaagcaggaaggcaaaaactgggctatcagaaagcctctgcacaaggacaccgtgagcgggctcgttcagctgtcctgggtgaaagtccccaagggcaaagtgatgacagccacgcgcaagtctctggatagctcctttgaccttaaaaccatcgccacaattaccgatacaggaatccaaaagattctgatcaagtacctcgagtctaaaggcaataaccccgaaagcgctttctcccctgaggggattgaggactttaataacaatatccacctgtataacgatggaaagaaacatcggccgatcaccaaggttagactctacgaaattggctctaaattccccctgggggagaagggaaataagaacgccaaatatgtggaagctgccaagggcacgaatctgtttttcgcggtctacgccaacaataaaggggagcgcagcttcgaaacaatccctcttaacctcgtgattgaccggctgaagctgggcctttccgctgttcccgagaccaatgagaaaggagataacctgctctttcacctgagccctaatgacctcgtgtacgtcccctctgaagatgagatggaaaacctgaaacttatcaacctggagcatatttccaaagaccagctgaatagaatctataagatggtgagctctacctccaaccggtgtttctttattaagagcgagatcgccctctccatcgtgaataaaattgaatactctcctctgaacaagatggagaaaagcatcgaaggcattatgatcaaggatgtctgccttaaactgcaggttaatcgcattgggaacctcgagagatatttctcctga

SEQ ID NO: 4476 - RNA, 4257 nt, synthetic construct
  misc_feature 1..4257: note = Cas9 variant
  source 1..4257: mol_type = other RNA
atgaaggtgaaaaacatcctgggcctcgacattggggtcaccagcatcggattcgcccacgttacagagaatgaaaaggataacaaatcccatattaagcagctgggcgtgagaatcaatccccttacggtggacgagcaaaccaactttgaaaaagggcggcctgcttctgtcaatgccgatcgcacactgaagagaggagcgcggaagatgctcagccgctacaaagacagacggaagaacctgattgagatcctttccaaaaccggcttcatcaattctgaaagcattctggctgaggatgggaagaacacaacccactccacatgggccctccgcgccaaggcttctagagagcggatcgaaaaggacgagctgggacgcgtgctgctcgccattaataagaaaagaggctataagagctcccggaaagctaagaacgaagatgagggccaggccatcgacgggatggcgattgccaaacgcctgtacgaggaaaatcttaccccgggacagctggtttatcagctcctgagagagggcaagaaatacatccccgatttttatcggagcgaccttcaagatgaactggacaaggtgtggaacttccagaagcagtttcatcaggagattctcacggataccttctacaaagacatccaagggaagggacagcgcgctacatctgcctccttttatggcgtctacgggttcaataccgctgaaaacaaaggaagcagagaggagaagcggctgcaggcctacgcgtggagatctgacgccctgacaaaacagctcacccgcgaagaggtggcttttgttatcacggaaattaataacaacctgaataactccagcggctatcttggcgccatctctgatcggtccaaggagctgttctttaataagaaaacagtggggcaatacctctatgaacagctgcagcaaaaccctcacaccagacttaagaatcaggtcttctaccgccaggactatctggatgagtttgagacaatttggaccatccagagccggtactatcccgaactcaccgacgatctgaaaagagagattcgcgacgtggtgatcttctaccaacggaagctgaaatcccagaagggactcgtctctttctgcgaactggagagcaaggaaatcatgattgagaaaaacggcaaggctgccgttaaaaagatcgggtccaaagtggcccctaagagctctcccctttttcaggagttcaagatttggcaagtgctgcataatgtcgatatcaaaaacaagaaagacaagacaaaaagacctctcgatgactccgaaaaggagtacctgtttaatgaacttaacattaaaggaaatctgaaggctgcgaaggtgatccaactcctgacgctgaacaaaaatgagaccgagctcaactatacacagctggaaggcaatcgcacccagaaggccctttacgaggcttatctgaaaatcctcgatacagaagggtacgacgttaacaacctgctgggaattaagagcaataaagacgaggtgttccttgatgacctcgatgtcaacgccctggaaatcaagaccatgattaagcagatctttaatgccctgaacattaatacgggcatcctcgacttcgatgctgagctggacggcaaagcctttgagcaacaggcgtcttatcacctttggcatctgctctacagctatgaagaggatgggtccaagtctggaaacgaacacctgtacaaactgcttgagaataagttcggctttaaaccggaacacgctcggattctcgccgggatcacactgagcgacgattacggaaacctgtccgccaaggctatgagaaagatctatccccagattaaagagaataacttcagcaccgcctgtgagctcgtgggctaccgccattctaaaaattccctgaccaaagaagagaaccaggaacggcctcttaagaataaactggagctcctgaagaagaacagcctgagacaacccgttgtggaaaagatccttaatcagatgattaacctcgtcaacgagctgatcgacaaaaattctgagaaagatgaacaggggtccattatcgagtattttcggttcgacgaaatccgcattgagctggctagagagctcaagaaaaacacagatgaacggagagacctggacgccgcgatccgcgagggcaatcttcggaacgaaaagatttacaaactgctccaagcccagtttggaatcaagaatcctaccagaaacgatattatccgctatagactgtacgaggaactgaagaataacggctataaagacctttacacaaatagctacatcccccaggagaaactcttcgggaaagagattgatatcgaccacattatcccgcagtccaagctgttcgatgactcttttagcaacaaaacgctgacctataatacaaccaacaaggataagggaaatcaaacaggcttcgactacattgaatccaaatatgggatcgatggaatcgaggcttacaccgcccggattgaaaacctctttgagtctggcaagaaaaataaggaagagggggtgagcaaagctaagtatcagaagctgcttaaaaaggagtccgaaatcggcgacggattcattgagcgcgatctgagagaaagccagtacatcgccaaaaaggcgaaagagctcctgctgcagattacgcggtctgtcgtggccacctccggcagcatcacagctcgccttagagaagactgggatctggttaacgtgatgaaggagctcaacctgcctaagtatcgggccctcgggctgaccgagatggaggaacgcaaatacggacaaaaggtcgaagtgattaaagactggacaaagagagacgatcaccggcatcacgctatggacgcccttaccatcgcctttacgaaacataatcacatccagtacctgaaccatctcaatgctcgcaaggatgagcagcacaaggagcacaaaattatcaacgcgattgaaaataaggagacaatcctgattaccgacaaatctggcaacagaaagcgggttttcaaagcccccatgcctaattttagacagacagctaagcaatatctggaagaggtgcttatctcccataaagccaagaacaaggtcgtgaccaaaaataagaacaaaatcctggggaaggaaaagattcaggagaccctcacaccccgcggacagctgcacgatcaaacgatctacggcttcaattggtggagccggattaccctctctaagaaggtgagcagaaacgagatcgagaaaattatcgacaataacacaaagtttttcctgcaggaatttatccagcttaaagggtccattgccaaggctttcagcgatgccgaactgaataaactcatgtataagggcaagatcctgaaagagattgaagttgcgatcccctgctacacccagcgcattgacatctctaaggtctttacagattcccagaaaagcaactccgctaaggagaaaaatattaagaacatcctggaccttaaggtgcggaacatcctgcagaatagactctctgagttcaaaggagatttcaagaaagcctttagcgacctggacaagaaccctatttggttcaataaagaaaagggcatctccattaaacgcgtgatcatttctggggtcaagaacgtggagccgctccattataagaaagatcacctgggaaatgacatccttgatggcaaggaaaaccggatccccgttgactttattagcaccgggaataaccaccatgtggccatctaccaggatgagaaaggaaatctgcaggaaaaggtcgtgtccctgttcgacgctgttaaactcgtgaacgccgatgagcctgtcattgacaagacgtataatcaaggcctggggtggcagtttcttttcacaatgaagcagaacgagatgtttgtgttccccaatgataacaccggctttgaccctaaagaaatcgatctgctcgacccctctaataagaaactgattagcccgaacctcttcagagttcagtccatcagcatcgtgcaatacggaaacaatattgtccgcgattttaagttccggaaccacctggagtctgtgcttaatgacgacaaagtgctgcatggcatcaccttccagcagattaagtccctggggcctctcctgaacatcgtcaaggttagaattaatcaccttggagatatcgtgagcgtgggcgaatactga

SEQ ID NO: 4477 - RNA, 4260 nt, synthetic construct
  misc_feature 1..4260: note = Cas9 variant
  source 1..4260: mol_type = other RNA
atggccaagccccagaactacaccatcggcctggacattgggacaaatagcgtgggatggacggtcaccgatgaccaaaacaatatcctcagaattaaatccaagaaagctatcggcgcccggctgttcgaggaagggaaggttgcggctgagcgcagatcttttcggacaacccgcagacggcttagccgcagaaaatggcggattaagctgctcgaagaactgttcgatgaagagatctccaaggtggaccctaactttttcgcccgctctcacgagagctggatctccccgaaagataagagagaacggtattctgccattgtgtttcccacacctgaggaagacaaaaagttccataatgagtaccccaccatctatcaccttcgcgatagactgatgaaagacgatcagaagcatgacattcgggagatctacgtcgctattcaccatatcatgaagtatcgcggaaactttctccacgatgaaagcattgagacatacagatccggcatgagctctcttgggggaggcgacgaacggaccatcctgaatacgaaaatcctcgatgacctgaacgacgccttcgctgataatcttgccacccagggcatttccgtgaacagcgcgtctgccgaccagatcaatgagattgttacatccgggcacctgaacgtggatagccaaaaggctatcgccaaactcctgcttcctaccacactgtcttccgacgataagaaacaggacaagaaaattaagaagctcgctaccgatgccgcgaaaaatgtcgccagcgcttggctgggatataaggccaactttgctgccatcctgaatatccaggaagtggacaaagataagaaaaagatttactccttcgccctccagggcgctgacgaggaggataaggttgaaacgctggagtctgtgcttagccaagaccagatcgaaattgtcgacagaatcattcgcatccggcatgcgatcgtgctgggggagattatccccgtgggaatgacactctccgaagccatgattgagaaatacgatcagcacgctaaggacctgaaaaaccttaagaccgtcatcagaaacctgaaagatcgcaagaatgccgttaagctccaggccatttatgacctgtacgtgaacaatcggcatgctgatacagccaaagcgatgaagctggctggcgtgaaaaagagaaccgagctcctggaacctgaggaatttaacaaaagcatcgagaagctgctggacgattctccggtctccgccgaaattaagaaacgcatcgccgagaaggacttcctccccctgcaacggagcaattctaacggggtgatccctaatcagcttcaccagattgagctggatgaaatcattaaaaagcaaagcaaatattacccctttctcggagagaccaacgaacacgcttccgccgacgttgctagaaaggcccctacaaaactggatcagctgctcacgttccgcgtgccctattacgtcggcccgctgatcaccaaggaggagcaggaggagcaggacggccattctttcgcgtggatgattcggaagaatcctaaagatcacgaaaagatcacaccctggaactttgacgagaaagtggacagaatggccagcgctacccaattcatcaagcgcatgacaaccaaagatacgtatcttctgggggaagacgttctcccttccagctctctgaagtaccagctgtttacagtgcttaatgagctcaacaatctgcggattaaccataagaaactgaccagagaggaaaaggagcaggtcatcgaagatctcttcaaaaagtacaaaaccgtgaaggccgacaagtttaaaaattattggcagaagggacacgctggcctggatgtcaaaattcaagggatggccgaccccgagaagttcaactccacaatgagcacctacatcgatcttcagaaaatttttggagaccagctggatgacgcgcagcggcaaaacgatttcgaaaagatcatcgagtattctacaatttttgaggaccgcaagatcctcggcgaaaaactgagagccgatttcgtgtggctgtccgaggaccagattaagcggctttgcagactccgcctgcaggggtggggacggctgagcctcaaactgcttacgagactgaccgacgctgatggccagaatgttctcgaacgcctgctgaactccaatgacaactttatgcaaatcgtgaaggatcccgtcattaaagccaagatcgagcagaaaaatcagaaacttctcagagctgactggtctgaaaacgccacagagagcatcctggatgaggcctacacctcccctcaaaataagaaggctattcggcaagtgatgcgcgttgtgcatgacatcgtcaaggcgtgtgatggcaacctgccggccaaattcgctattgaatttgccagatctcaggacgatgaccccaagcggacagtggcccgcgctgatagactccagaaaatctatgcccaaattagcgacgaggtggtttcccagggggtcaaggaccagctgagcggaatgaagtctcttaaagatcggtactatctgtacttcatgcagggcgggcgcgacgcgtacaccggaaagcctctcaatatcgatagactgtccgactatgatattgaccacatcatgccccagagcttcatcaaagatgactctctggataaccgggtgcttgtgacgcgcgctgtcaataaccagaagtccgacaatgtgcctgttctcctgtacggcaaccacctggtggccgatctcgggattaccatcagagaaatgtgggaccggtggcagaaaagcggcatgatttctaagagaaagctggccaatcttctgacagatcccgctaccctcagcgagtatcgcgccgagggatttatcaaccggcagctggtcgaaacatcccaagtgattaaactgaccgcgacgatccttcagagcgagttcccggactctaagatcattgaagttcctgctaaatacaactccatcctgagaaagcagtttgacctctataaaagccgcgaggtgaatgattaccatcacgccattgacgcctatctgtccacaatcgtcggcaactacctctaccaagtgtatcccaatctgcggagacttttcgtttacggggaatttaagaagttctctcatggagaggaggaaagctcccaccaggctgtgcgccgggtcaaatctatgaactttctggatgacctcctgagaggcaagcacggggatgacatttattgccgcgtgaccggagaggtgatcttcagccggaaagatatcatttccaagctgaaacaggcctactcttttaagcagatgcttgtcacacaagaagttttcaccaagaaaagcgctctgtttgaccagaccgtgtatccttcccccgccagagatagcaagacacggtctggcctcatccctcgcaaacaggggatggacacggagatttacggcggatattccggcaataaggatgcgtacttcgtgctggcccaggtcgtgaaaagcaaggggcataccctccaagttgtgggagtccccatcagagctctgcgggcccttgctaactgttctaattactccgaacagctgctcaaaattgtgaaggcccaggttctgtttaacaagaaaacaggcaaggccaaaaaggggatcagcgacgtgcgcattctgcttgataaaatcccgtatagacagcctgtcctggacggatctgctttctacatgctcggctccagcacctataagtacaatctgaagcaaatctccctcagccagcagtctatgaaatatattctggactacatcgatgaccccaacttcaataagcacgagatgacaaaaattgatcagcaaaacgagaaggaatgccttctgagcgtgtatgacgagatcctggataaaatggacaagtacctctccctgtacgatattaatgggtttcggaagaaacttcatgttggcagagacaagttcatcaaactggaagtggagaagcaggcggaagccatcaaaaacgtcctccgcggatttcacgctaattctgatatgaccaagctgagcgacctcggcctgtccacgtctcttgggttcatgcaggccagcgatggaattaagctgtccgacaacgccgtgtttatctatcaatctcccacaggcctgttcgagcggagagtgaaagtcagcgacctcctgaagtga

SEQ ID NO: 4478 - RNA, 4260 nt, synthetic construct
  misc_feature 1..4260: note = Cas9 variant
  source 1..4260: mol_type = other RNA
atgatgatcaagaacattctgggcctcgacctggggaccaatagcatcggatgggcccttattaaacagaacttcgagaataagtacggcgaaatcctggggatgggatccagaattatccccatgtctcaagatgtgctcggcgagtttgggaaaggaaacagcgtctcccagacagctgcccggacgggctatcgcggcgttagacggctgcgcgaaagattccttctgcggcgcgagagactccaccgggtgctgaatgtgctgaactttctccctgaacattacgcgtctcagatcgacttcgagaagcgctttgggaaattcaagtatgagaccgaaccgaagctggcttacaataacgatggatttttctttaaaaatagcttcgacgagatgcttggcgattttaaggaccaccagttccatctgctcgaaaacgggagaaaagtcccctatgattggacaatttactatctgcggaagaaagccctttcccaaaagatcgagaaggaggaactggcctggattctcctgaattttaaccagaaacgcggatactaccagctgagaggcgaggacttcgaagaggaaaaggatcgggtgttcgttcgcctcaaagtggacagagtcgtggattctggggagaatatcaagggaaaaattctgtatgacgtttactttgagaacggctggaagtatgaaaaacagatcgtgaagaccgaggattggattggccggacaaaggaatttatcgtcaccgagagcatccttaaaaatggggacacaaagagaacctttaaagctgtggactccgaaaaggattggattgccatcaaaacgaagaccgagcaagagattgacaagagccacaaaacagtgggagcttacatctatgaagccctgctccagaaccctaagcagaaaattaagggcaaactggtccgcaccatcgagcggaagttctacagagaggagcttaagaaaatcctggaacgccagaaggagtttcatcccgagctccaatctgatgacctgtataacgattgcattcgggaactgtacagaaataacgaggcgcaccagatcacactctccaaaaaggacttcgttcatctgcttctgaatgatctcattttctaccagcgccctctgcggagccaaaaatcttccgtgagcaactgtacccttgagttcagaaagtataaggacgaaaatggggtggagcacgcccagtacctgaaaacgatccccaagtctaacccttattaccaggaatttcgcgtctggcagtggatgttcaatctcaacatttatcggaaagatgacgatacaaatgtgaccaaggagtttctgtccagcacagaagactacgagaccctgttcgaatttctcaacaatagaaaagaggttgaccaaaaggctctgcttcgccacttcaaactgaacgagaagacccatcggtggaattatgtggaagataagaaatacccgtgcaacgagacaaagacgatgatctccaccagactcgaaaaagtcgagaattacccctctgacttcctgacacgggaaatggagcagaacatctggcacattatctatagcgtgaacgataagattgagtacgaaaaagccctgaagtcctttgctcacaagaataaccttgacgagaatagcttctttgaagccttcaaaaagtttcctcccttcaaatctgagtatggatcctttagcgaaaaggcgatcaaaaagctcctgcctctgctccgcctgggcaagtactggaactgggagtctattgatagaaaaagccaggggcggatcgagaagattatcaccggagagttcgacggcaatatcaaagataaggttagagaaaaagccattcatcttacagctgaaaacgactttcagggcctgcaactctggctggcccagtatatcgtgtacgggcgccactccgaggcttctatgattggaaagtggaatagcgccgatgacctggaggagttccttaagggctttaaacagcattccctccggaaccccatcgtcgaacaggtgattaccgaaacgctgagagtcgtgaaggatatctggctgaaatatgggaatggagccaaggacttctttagcgaaatccacattgaactcggccgcgagatgaaacaaacaaaggatgagagagttgacgctaccaaacggatcaccgaaaacgagaatacaaacctgcgcattaaggcgcttctggccgaaatgatgaatgacaactctgtggagaatatcagaccgtactcccctatgcagcaggaaattctcaagatctacgaggatgggatcctgaaaagcgacattgagatcgatgacgatattctgaagatctctaaaaccgctcagccctccagctccgaccttaagcggtataaactctggctggaacaacgctacaagtctccttatacaggccagattatccccctgaacaaactcttcacgagcgagtacgaaatcgagcatattatcccccagtccagatatttcgatgactcttttagcaacaaaattatctgtgaatccgccgtcaataagctgaaagataactacattggacttggcttcatcaagcaatttgggggaatgattgtggagtgcggcttcgggaaaagcgttgagatctttaaggccgaagagtatgaagacttcgtgaagaaacactacgctaataaccggtctaagcgcaataaactgctcctggaggagatccctgaaaagatgattgatagacagctgaacgacacccggcacatctccaaatacattagcggagtcctttctaatatcgtgcgccaggaggatggcacagacgaaggggtgaactccaagaatattgttccgggcaacggaaagatcaccacacagctcaaacaagactggggcctgaatgatgtctggaacgagctgatcctccccagatttgaacggatgaatcagctgaccaacagcacggacttcacctcttggaataagaaccatcagaaatttcttcctacagtgcccattgagttcagcaaggggttttccaaaaagagaatcgatcaccgccatcacgccatggacgcgctggtgattgcttgtgccaccaaggatcacatcaacctcctgaataaccagagcgccaaatctgacacaaagcggtatgatctgaaaagaaaacttatgaagttcgagcgcgtcgtgtactcccatagcaagaccggagaaaagattgagaaggaagttcctaagcaattcctgaaaccctgggacaattttacggtggatgctaagaacaaaatggagacaatcatcgtctccttcaagcagaatctccgggtgattaacaaagccaccaatcactatgaaaagtggatcgagaaggacggcattaaaagaaaggagctgatcaaacaggaagggacaaactgggctattcgcaagccgatgcataaagagaccgtttctggaaaggtggatctccctggcatcaagattcccaaagggaagatcctgaccgccacacggaaaagccttgacacgtcctttgacctgaagaccatcaattctattacagataccggcatccagaaaattctcaagaactacctggagttcaagggaagctccgaactggcgttttctcctgaaggcatcgaggacatgaataaaaacattgagaagttcaatgatgggaaaccccaccaaagcatcaacaaggtcagaatctttgaacttggatccaaattcagcgtgggccagacagggaataagaaagacaagtatgttgaggccgctaagggaaccaacctgtttttcgccgtgtacgaagataaaaatggcaagcgctcttatgagacgattcctctcaacgaggtcatcgaacggcagaaacaagggctggactccgtgagctttaagaacaaagaggatttcctcctgtgccccaatgaccttgtgtacgtcccgtctgaagatgagctggaaaacatttacaatatcgactttaagaacctcacaaccgagaagaccggcaatatttataaagttgtgtccttcagcggaaaccagatcttctttatcagacaggatattgctatctctattgtgaataaggccgagttctccacactgaacaaaatggaacgggcgatcgacggcagcatgattaaggagaattgtatcaaactgaagattgatcgccttgggaacatcgccaagatctga

SEQ ID NO: 4479 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttacggacgatcagaataacatcctcagaattaagggcaaaaaggctatcggggcccggctgttcaccgagggaaaagtggcggctgaacgcagatcctttcggacaacccgcagacggctttctcgcagacggtggcgcattaagatgctggaggaactcttcgacgaggaaatcgccaaggtggatcctagctttttcgccagactgcacgagtcctggatctctccgaaagacaagcggaaacgctatagcgctattgtctttccctcccctgaggaagataagaaattccatgagtcttaccccacaatctatcaccttagagacaagctgatgaaggatgaccaaaaacatgatattcgggaaatctacattgccgtgcaccagatgatcaaggctcgcggcaattttctccatgacgagagcgttgagacctatagatccgggatgagctctctgggaggccggtccgaaagaacaattctgagcgtgcagaccctcgaggaactgaacgatcttttcgccgagaatgaaggcacggaggaggtcgaactgaacgtggcgtctgccgagcagatcaatgacatcctcaccgggggacacctgaacgctgactcccaaaaagaaattagcaatcttctgctcccttcttcctttcccagcttcgatgacaaggccaaagagaagcaggttaaaaagctgatcaacaatgtggctacaaacatttccaaggcctggctgggctacaaagcggatttttctaccatcctcaatctggccaaggtcgacaaagatcagaagaaaattttcgcttttgcccttcagggggaagacgaggaggataaggtgcaagaactggagagcctcctggaacagtcccagacagacatcgtggatcgccttatcgagattcggcacgctatcgtcctgagcgaaattgttcctgtgggaatgaccctctctgaggccatgatcgacaagtatgatcagcataaagaggacctgattacgctgaaggccgtgatcagaaacacaaaagacaagaaaaaggctgcgaagctccaagccatctacgatctgtacgtcaaaaatcgccacgctgaccttgccaaggccatgaaactgaccggcattaagaaacggtccgaactcctggatccggaggaacttaagaaggggatcagctctctgctcgacgatagccccgaggctgtggagattaaacagagactggaagagaagacattcctgcctctccagcgctccaacaacaatggagttatccccaaccaactgcatcaggtggaacttgacgagattatcaaaaagcagtctaaatattaccctttcctggccgaaaagaatcccgatgagagcgaggaagcgcagaaaaaggctccgaccaagctcgacgccctgctgacctttcgggtcccttattacgtgggccccatgattacaaaagaggaacaagaggcccagaacggccactccttcgcttggatggttagacgcgatcctcaggaccacgaagccatcacgccctggaattttgagaagaaagtggataagatggctagcgccacccagttcatcaaacggatgacaaccaaggacacatatcttctcggggaggatgtcctgcccgcgtcttccctgaagtaccaactctttaccgtgctgaacgaacttaataacctgagagtcaatggaaagaagctcacgagcgacgagaaagaacaggtgattgagggcctgttcaagaaacagaagacagttaaggccgacaaatttgtgaagtattggcaggctaaacatatcggggccgatattaaggtcaaaggactgtctgacccttccaagttcaacagcaccatgtccacctacatcgattttaagaaaattttcggcgaccaacttaatgatgtgaaccgccagaatgactttgaaaagatcatcgagtactctacaattttcgaggatcggaaaatcctcgaagacaagctgagagctgattttgcctggctgagcgaggaacagattaaacagctctgccggctgcgccttcaagggtggggaagactgtccgacaagctcctgacccggctgacagatgcggacggccagaacgttcttgagagactctggaactctaatgataacttcgtgcagatcgtcagcgacccgaatattaaagccaagatcgagcaagaaaaccagaagctgctgcgcgactcccagagcgataatgctgtggagtctatcctcgacgatgcctatacgagcccccagaacaaaaaggctattcggcaagtgatgagagttgtccacgacatcgtgaaagcctgtgatggcaatgtgcctgccaagttcgctattgaatttgcgcgctcccaggaggacgatcccaaaagaaccacagcccgggtcaaccagatgcagaagatctacgaccaaatttctgatgaagtggtttcccagggggtgaaggagcagctgagcggaatgaaatctcttaaggaccgctattacctgtatttcatgcagggcgggagagatgcttacaccggagccaaactcaatatcgaccggctgagcgactatgatgtcgaccatatcatgcctcaatcctttgtgaaggatgacagcctggataaccgcgttcttgtggccagagctgtcaataaccagaaatctgacaaggtgcccgccctcctgttcggcaataaggttgtggcggatctggggattacagtccgggagatgtgggacaaatggcagaagctcggcatgatctccaaacgcaagctgagcaaccttctgaccgatccggacgctctcacggaatacagagcccaaggatttattcggcgccagctggtggagacctcccaggtgatcaaactgacagccaccattcttcagtctgagttccctgatagcaagatcattgaagtccccgctaagtacaattccatcgttagaaaacaatttgacctgtataagtctcgggaagtgaacgatttccaccatgccatcgacgcgtacctcagcacaattgtgggcaattatctgtaccaggtctatcctaacctcagacgcatgtttgtgtacggggagttcaaaaagttttcctctaacgctgaggaaagcgcccacgacgttgcccggagagtgaaatccatgaatttcctggatgaccttctgcgcggaacccacggcgataacatctattgccggagcacgggggagattgtctttaatagaaacgacatcatttctaagctcaagcaggcttactccttcaaacagatgctggtgacacaagaagttttcacccgcaagagcgccctgtttgatcagacagtgtacccctctcctgagcgggactccaaaaagagaagcggacttatcccccgcaaaaagggcatggatccggaaatctatgggggctacgctcataatcaggactcttatttcgtcctggccaaaattgagaaggtgaagggatacaccctccagatcgttggcgtgcctattcggtccctggagatcattaacaaagcggaagattttagcaccgccctcctggacatcatcaagtccaaagtcatgtataatgagaagacagggcaacccaaaagaggaattaagaacgtggaaatccttgtgaataagctgccctaccggcagcctattctcgagaaagatgtcagctatatgctgggctctagcgcttacaagtacaacatgaaacagatcacgctgtcccgccagtctatgaagtatattcttgactacatcgatgacccgaatttcaccaaacacgagatgacaatgattgacgaacaaaacgagagagaatgtctgctcagcgtttatgatgagatcctggaaaaggtggacaagtacctccccctgtttgatgggaataaattccgggagaaacttcattccgcccgcaaagagtttgtgtctctgagcgtcgacgatgaggcttccgccatcgaaaagattctgagaggactccacgccaactctgaaatgcctagcctggagaatcttaaaatcaagcccgctctgggcttctttcagatgaagaacgggattaccctctccaacgacgcggtgctgctctatcagagccctacaggcctgttcgaacggagagttaaagtgtctgatcttctgaagtga

SEQ ID NO: 4480 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttacggacgatcagaataacatcctcagaattaagggcaaaaaggctatcggggcccggctgttcaccgagggaaaagtggcggctaagcgcagatcctttcggacaacccgcagacggctttctcgcagacggtggcgcattaagctgctcgaagaactgttcgacgaagagatcgccaaagtggatcctagctttttcgccagacttcacgaatcctggatctctccgaaggacaaacggaagcgctatagcgctattgtctttccctcccctgaggaggataaaaagttccatgaatcttaccccacaatctatcacctgagagacaagctcatgaaagatgaccaaaagcatgatattcgggagatctacattgccgtgcaccagatgatcaaagctcgcggcaattttctgcatgacgaaagcgttgagacctatagatccgggatgagctctctgggaggccggtccgagagaacaattctcagcgtgcagaccctggaagaacttaacgatctgttcgccgaaaatgagggcacggaagaggtcgagctcaacgtggcgtctgccgaacagatcaatgacatcctgaccgggggacaccttaacgctgactcccaaaaggagattagcaatctgctcctgccttcttcctttcccagcttcgatgacaaagccaaggaaaaacaggttaagaagctgatcaacaatgtggctacaaacatttccaaagcctggctcggctacaaggcggatttttctaccatcctgaatcttgccaaagtcgacaaggatcagaaaaagattttcgcttttgccctgcagggggaggacgaagaggataaggtgcaagagctcgaaagcctgcttgagcagtcccagacagacatcgtggatcgcctgatcgaaattcggcacgctatcgtcctcagcgagattgttcctgtgggaatgaccctgtctgaagccatgatcgacaaatatgatcagcataaggaggacctgattacgctcaaagccgtgatcagaaacacaaaggacaaaaagaaggctgcgaaactgcaagccatctacgatctttacgtcaagaatcgccacgctgacctggccaaagccatgaagctcaccggcattaaaaagcggtccgagctgcttgatccggaggagctgaagaaagggatcagctctctcctggacgatagccccgaagctgtggagattaagcagagaatcgaggagaaaacattcctgcctctccagcgctccaacaacaatggagttattcccaaccaactgcatcaggtggagcttgacgaaatcattaagaaacagtctaagtattaccctttcctggccgagaaaaatcccgatgaaagcgaggaggcgcagaagaaggctccgaccaaactcgacgccctgctgacctttcgggtcccttattacgtgggccccatgatcacaaaggaggagcaagaagcccagaacggccactccttcgcttggatggttagacgcgatcctcaggaccacgaggccatcacgccctggaattttgagaaaaaggtggataaaatggctagcgccacccagttcattaagcggatgacaaccaaggacacatatcttctcggggaagatgtcctgcccgcgtcttccctgaaataccaactctttaccgtgctgaacgagcttaataacctgagagtcaatggaaagaaactcacgagcgacgaaaaggaacaggtgatcgaaggcctgttcaaaaagcagaagacagttaaagccgacaagtttgtgaaatattggcaggctaagcatattggggccgatatcaaagtcaagggactgtctgacccttccaagttcaacagcaccatgtccacctacattgattttaaaaagatcttcggcgaccaacttaatgatgtgaaccgccagaatgactttgagaaaatcattgaatactctacaatcttcgaggatcggaagattctcgaggacaaactgagagttgattttgcttggctgagcgaggaacagatcaagcagctctgccggctgcgccttcaagggtggggaagactgtccgacaaactcctgacccggctgacagatgccgacggccagaacgtgcttgaaagactctggaactctaatgataacttcgtccagattgtgagcgacccgaatatcaaggcgaagatcgagcaagagaaccagaaactgctgcgcgactcccagagcgataatgccgtggaatctattctcgacgatgcttatacgagcccccagaacaagaaagccatccggcaagttatgagagtcgtgcacgacattgtgaaggcttgtgatggcaatgtccctgccaaattcgccatcgagtttgctcgctcccaggaagacgatcccaagagaaccacagcgcgggtgaaccagatgcagaagatttacgaccaaatctctgatgaggttgtgtcccagggggtcaaagaacagctgagcggaatgaagtctcttaaagaccgctattacctgtatttcatgcagggcgggagagatgcctacaccggagctaagctcaatatcgaccggctgagcgactatgatgtggaccatattatgcctcaatcctttgttaaagatgacagcctggataaccgcgtgcttgtcgccagagccgtgaataaccagaagtctgacaaggttcccgctctcctgttcggcaataaagtggtcgccgatctggggatcacagtgcgggagatgtgggacaagtggcagaaactcggcatgatttccaagcgcaaactgagcaaccttctgaccgatccggacgcgctcacggagtacagagctcaaggatttatccggcgccagctggtggaaacctcccaggtcattaagctgacagccaccatccttcagtctgagttccctgatagcaagattatcgaagttcccgccaaatacaattccatcgtgagaaagcaatttgacctgtataaatctcgggaggtgaacgatttccaccatgctattgacgcctacctcagcacaatcgtcggcaattatctgtaccaggtgtatcctaacctcagacgcatgtttgtttacggggagttcaagaaattttcctctaacgcggaagagagcgctcacgacgtggcccggagagtcaagtccatgaatttcctggatgaccttctgcgcggaacccacggcgataacatttattgccggagcacgggggaaatcgtgtttaatagaaacgacattatctctaagctcaaacaggcctactccttcaagcagatgctggttacacaagaggtgttcaccaaaaagagcgctctgtttaatcagacagtctacccctctcctaaacgcgatggatccaagcggagcggccttatccccagaaaacgcgggatggacccggaaatttatggcggatacgcccataaccaggattctcacttcgtgctggctaagatcgagaaggttaaaggctataccctccagattgtgggggtccctatccggtccctggaaattatcaataaggccgaggactttagcaccgcgctcctggatatcattaaatccaaggtgatgtacaacgagaaaacaggacaacccaagagaggcatcaagaatgtggaaattcttgtcaacaaactgccctatcggcagcctatcctcgagaaggacgttagctacatgctggggtctagcgcctataaatacaatattaagcagatcacgctgtcccgccagtctatgaaatacattcttgattatatcgacgatccgaacttcaccaagcatgaaatgacaatgatcgacgagcaaaatgagagagaatgtctgctcagcgtgtacgacgagattctggaaaaggtggataaatatctccccctgtttgacggaaacaagttccgggagaaacttcactccgctcgcaaggaatttgtctctctgagcgtggatgacgaggcctccgctatcgagaaaattctgagaggcctccacgccaattctgaaatgcctagcctggagaaccttaagatcaagcccgccctggggttctttcagatgaaaaacggcattaccctctccaatgatgctgttctgctctaccagagccctacaggactgttcgaacggagagtgaaggtctctgaccttctgaaatga

SEQ ID NO: 4481 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtgcccgcctttaagttcaaagtcctcggcaacacagagaaggaaaagatcaagaagaatctgattgggagcacgacctttgtgcctgcgcagtccgctcaaggaacacgggttttccgcgtgaacagacggcgcatcgatagacggaatcaccgcattgcctatcttagagacatctttcagaaagagatcgaaaaggtcgataaaaacttctaccggcgcctggacgagtcttttagagtgctcggcgataagagcgaggagctgcagattaaacagccgttctttggggacaaggagcttgaaaccgcctatcataagaaataccccacaatctatcatctgcggaagcatctcgctgatgccgacaaaaattcccctgttgctgatattcgcgaggtgtacatggccatctctcacattctgaagtacagaggacatttcctgaccctcgaccggatcaaccccaataacattaatatgcaaaacagctggatcgattttatcgaatcctgccaggaggtcttcgacctggagattagcgacgaatctaaaacaatcgtggcgatttttaagtccagcgataatcgccaggagaaagtgaagaagatcctttcttatttccagcaagaactgctcaaaaaggacaaatccattttcaagcagctgcttcagctgctctttggcctgaaaaccaagttcaaggattgttttgagctggaagaggagcctgacctcaacttcagcaaagaaaattacgatgagaacctggaaaactttcttggctctctggaggaagacttctccgatgtctttgccaagctcaaagttctgagagacacgatccttctgagcgggatgctcacctatacaggaaccacacgggctagattctccgccaccatggtggagcgctacgaggaacaccggaaggatctgcagagatttaaatctttcgtgaagcaaaatctgagcgagcaggactatctcgatatctttggccgcaagacgcccaacgggttcgacgtcgacaaagaaacaaagggatacgtgggctatatttccaataaaatggttctgaccaaccctcagaagcaaaagacaatccagcagaatttttacgattacattagcgggaagatcaccggaattgagggcgctgaatatttccttaacaagatctctgacggcaccttcctgcggaaactcagaacaacggataatggggccgtgccgaaccagatccacgcgtacgagctggagaagattatcgaccgccaaggagaagattatccctttcttctggagaataaagacaagctcctgtccattctgaccttcaaaatcccttactatgtcggccccctcagcaaggggaacaattctcggtttggatggattaaaagaacaatcagccaggatattctggacgataacgacgaagatacccgcaatggcaagatccggccttggaactaccagaaacttatcaatatggacgagacaagagatgccttcattaccaacctgatcgggaacgacattatcctcctgaatgagaaagtgctgcccaagcgctcccttatttatgaagaggttatgctccagaacgaactgacgcgggtgaaatacaaggacaaatacggaaagacacactttttcgattctgagctgagacaagaaatcatcaataacctctttaagaccaataacaaacgggtcagctccgctatgctgcttgactatctggagaattacaccaacctccaggccgtggagattgtcagcggcatcgaaaagggcaaatctctcaattccacactgaagacctataacgatcttaaaacaattttcagcgaggaactcctggactctgagatctaccagaaggaactggaggagattgtgaaggttatcacggtgtttgatgacaaaaagtccatcaaaaattatctcattaagtacttcgggcacctggaatttcttaacgaggaacgcatcaatcagctgagcaaactcagatataccggatggggccggtactccgctaagctgctgcttgatattagagacgaggatacagggttcaacctcatgcaatttctgcgcaatgacgatgaaaaccggaacctgtctcagctcatcagcgactccaccctgtctttcgatagcgccattaagtccatccagagcaaatctacagtcgaggacgacgtgttcgatgagatcaagaaacttgccggatccccggctattaagagaggcatcctgaatagcattaaaatcgttgacgaactcgtgcagattatcgggtaccctccccaaaacattgtcatcgagatggcgcgcgaaaatatgaccacggaggagggccagaagaaagccaagaccagaaagacaaaactggaatctgctctgaagaacatcgaaaattccgtgcttgaaaacggaaaagtgcctcatagcgatgagcagctccaatctgaaaagctgtatctgtactatctccagaatggcaaagacatgtacagcctggataagaccgggtcccccacacccctttatcgggaccagctggatcagtacgaggttgaccacattatcccttatagctttctcccgattgattctatcgacaacaaggtcctgacccaccgcgagaataaccaaagaaaactgaataacattcccgataaggaaacggtggccaatatgaaacctttctgggagaaactttacaacgccaaactgatctcccagacaaagtaccagcggctcaccacaagcgaacgcacccccgacggagtgctgaccgagtccatgaaggctggctttatcgaaagacagctcgtcgagacacggcaaattatcaaacatgtggcccgcattctggacaatagattccttgatacgaagatcattgcgctgaaatctcagctcatcaccaactttcggaacacattccacatcgctaagattcgcgagctgaatgactatcatcacgcccatgatgcctacctggctgttgtggtcgggcagacccttctgaaagcctatcctaagctcgctcccgaactgatctacggacaccacgcccattttaacagacacgaggaaaataaggcgacaattcggaaacatctctatagcaacatcatgagattctttaataacccggactccaaggtgtctaaagatatttgggactgcaatcgcgatctgcctatcattaaggaggttatctacaacagccaggtgaatttcgtcaaacggaccatgatcaagaagggcgccttttataaccaaaatcccgtggggaaattcaacaagcagattgctgccaataacagataccctcttaaaacgaaggtttcctctctggacacaagcatctacggcggatatggccccatgaactccgctctcagcattatcattatcgccgaacgcttcaatgagaaaaaggggaaaatcgagaccgtgaaggaatttcacgatattttcatcattgactacaagaaatttaataacaaccctttccagtttctgaatgatacctctgagaacggattcctgaagaaaaataacatcaatcgggtccttgcgttttatggcgtgcccaagtactccctgatgcagaaaaacgacgggacaagaatgctgttcgaaagcaagtctaatctgcacaaggccacccaatttaaactcacaaagacgcagaacgagctgttctttcatatgcgccggcttctgaccaaatccaatctgatggatctcaagagcgagtctgctattaaagaatcccagaacttcatcctgaagcacaaggaggaatttgacaatatcagcaaccaactttccgccttcagccagaaaatgctgggagacacaacctctctcagaaatctgattaagggctataacgagcgcaaaatcaaggaaattgatagctccgaggaggtgatcaaatacttctatgacaattttattaagatgttctcttttgtcaagagcggggctccgaaaggcatcaacgatttctttaacaataagtacacagttgcccggatgagacctaaacccgacaagaaattcctcaacgccaccctgattcatcagtccatcacgggactttacgaaacccggatcgatctgtctaagctgggcgaggactga

SEQ ID NO: 4482 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtgcccgcctttaagttcaaagtcctcggcaacacagagaaggaaaagatcaagaagaatctgattgggagcacgacctttgtgcctgcgcagtccgctcaaggaacacgggttttccgcgtgaacagacggcgcatcgatagacggaatcaccgcattgcctatcttagagacatctttcagaaagagatcgaaaaggtcgataaaaacttctaccggcgcctggacgagtcttttagagtgctcggcgataagagcgaggagctgcagattaaacagccgttctttggggacaaggagcttgaaaccgcctatcataagaaataccccacaatctatcatctgcggaagcatctcgctgatgccgacaaaaattcccctgttgctgatattcgcgaggtgtacatggccatctctcacattctgaagtacagaggacatttcctgaccctcgaccggatcaaccccaataacattaatatgcaaaacagctggatcgattttatcgaatcctgccaggaggtcttcgacctggagattagcgacgaatctaaaacaatcgtggcgatttttaagtccagcgataatcgccaggagaaagtgaagaagatcctttcttatttccagcaagaactgctcaaaaaggacaaatccattttcaagcagctgcttcagctgctctttggcctgaaaaccaagttcaaggattgttttgagctggaagaggagcctgacctcaacttcagcaaagaaaattacgatgagaacctggaaaactttcttggctctctggaggaagacttctccgatgtctttgccaagctcaaagttctgagagacacgatccttctgagcgggatgctcacctatacaggaaccacacgggctagattctccgccaccatggtggagcgctacgaggaacaccggaaggatctgcagagatttaaatctttcgtgaagcaaaatctgagcgagcaggactatctcgatatctttggccgcaagacgcccaacgggttcgacgtcgacaaagaaacaaagggatacgtgggctatatttccaataaaatggttctgaccaaccctcagaagcaaaagacaatccagcagaatttttacgattacattagcgggaagatcaccggaattgagggcgctgaatatttccttaacaagatctctgacggcaccttcctgcggaaactcagaacaacggataatggggccgtgccgaaccagatccacgcgtacgagctggagaagattatcgaccgccaaggagaagattatccctttcttctggagaataaagacaagctcctgtccattctgaccttcaaaatcccttactatgtcggccccctcagcaaggggaacaattctcggtttggatggattaaaagaacaatcagccaggatattctggacgataacgacgaagatacccgcaatggcaagatccggccttggaactaccagaaacttatcaatatggacgagacaagagatgccttcattaccaacctgatcgggaacgacattatcctcctgaatgagaaagtgctgcccaagcgctcccttatttatgaagaggttatgctccagaacgaactgacgcgggtgaaatacaaggacaaatacggaaagacacactttttcgattctgagctgagacaagaaatcatcaataacctctttaagaccaataacaaacgggtcagctccgctatgctgcttgactatctggagaattacaccaacctccaggccgtggagattgtcagcggcatcgaaaagggcaaatctctcaattccacactgaagacctataacgatcttaaaacaattttcagcgaggaactcctggactctgagatctaccagaaggaactggaggagattgtgaaggttatcacggtgtttgatgacaaaaagtccatcaaaaattatctcattaagtacttcgggcacctggaatttcttaacgaggaacgcatcaatcagctgagcaaactcagatataccggatggggccggtactccgctaagctgctgcttgatattagagacgaggatacagggttcaacctcatgcaatttctgcgcaatgacgatgaaaaccggaacctgtctcagctcatcagcgactccaccctgtctttcgatagcgccattaagacaatccagtccaaaagcaccgtcgaggacgacgtgttcgatgagatcaagaaacttgccggatctccggctattaagagaggcatcctcaattccattaaaatcgttgacgaactggtgcagattatcgggtaccctccccaaaacattgtcatcgagatggcgcgcgaaaatatgacgaccgaggagggccagaagaaagccaagacaagaaagaccaaactggaaagcgctctgaagaacatcgaaaattctgtgcttgaaaacggaaaagtgcctcattccgatgagcagctccaaagcgaaaagctgtatctgtactatctccagaatggcaaagacatgtactctctggataagacagggagccccacgcccctttatcgggaccagctggatcagtacgaggttgaccacattatcccttattcctttctcccgattgatagcatcgacaacaaggtcctgacccaccgcgagaataaccaaagaaaactgaataacattcccgataaggaaacagtggccaatatgaaacctttctgggagaaactttacaacgccaaactgatctctcagaccaagtaccagcggctcacaacctccgaacgcacccccgacggagtgctgacagagagcatgaaggctggctttatcgaaagacagctcgtcgagacgcggcaaattatcaaacatgtggcccgcattctggacaatagattccttgataccaagatcattgcgctgaaatcccagctcatcacaaactttcggaacaccttccacatcgctaagattcgcgagctgaatgactatcatcacgcccatgatgcctacctggctgttgtggtcgggcagacacttctgaaagcctatcctaagctcgctcccgaactgatctacggacaccacgcccattttaacagacacgaggaaaataaggcgaccattcggaaacatctctattctaacatcatgagattctttaataacccggacagcaaggtgtccaaagatatttgggactgcaatcgcgatctgcctatcattaaggaggttatctacaactctcaggtgaatttcgtcaaacggacgatgatcaagaagggcgccttttataaccaaaatcccgtggggaaattcaacaagcagattgctgccaataacagataccctcttaaaacaaaggttagctccctggacacctctatctacggcggatatggccccatgaatagcgctctctccattatcattatcgccgaacgcttcaacgagaaaaaggggaaaatcgagaccgtgaaggaatttcacgatattttcatcattgactacaagaaatttaataacaaccctttccagtttctgaatgatacaagcgagaacggattcctgaagaaaaataacatcaatcgggtccttgcgttttatggcgtgcccaagtactctctgatgcagaaaaacgacgggaccagaatgctgttcgaatccaagagcaatctgcacaaggccacacaatttaaactcacgaagacccagaacgagctgttctttcatatgcgccggcttctgacaaaatctaatctgatggatctcaagtccgagagcgctattaaagaatctcagaacttcatcctgaagcacaaggaggaatttgacaatatctccaaccaacttagcgccttctcccagaaaatgctgggagacaccacaagcctcagaaatctgattaagggctataacgagcgcaaaatcaaggaaattgattctagcgaggaggtgatcaaatacttctatgacaattttattaagatgttctcctttgtcaagtctggggctccgaaagatatcaacgacttctttaacaataagtacaccgttgcccggatgagacctaaacccgataagaaattcctcaacgccacgctgattcatcagagcatcaccggcctttacgaaacacggatcgacctgtccaagctgggagaggattga

SEQ ID NO: 4483 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtgcccgcctttaagttcaaagtcctcggcaacacagagaaggaaaagatcaagaagaatctgattgggagcacgacctttgtgcctgcgcagtccgctcaaggaacacgggttttccgcgtgaacagacggcgcatcgatagacggaatcaccgcattgcctatcttagagacatctttcagaaagagatcgaaaaggtcgataaaaacttctaccggcgcctggacgagtcttttagagtgctcggcgataagagcgaggagctgcagattaaacagccgttctttggggacaaggagcttgaaaccgcctatcataagaaataccccacaatctatcatctgcggaagcatctcgctgatgccgacaaaaattcccctgttgctgatattcgcgaggtgtacatggccatctctcacattctgaagtacagaggacatttcctgaccctcgaccggatcaaccccaataacattaatatgcaaaacagctggatcgattttatcgaatcctgccaggaggtcttcgacctggagattagcgacgaatctaaaacaatcgtggcgatttttaagtccagcgataatcgccaggagaaagtgaagaagatcctttcttatttccagcaagaactgctcaaaaaggacaaatccattttcaagcagctgcttcagctgctctttggcctgaaaaccaagttcaaggattgttttgagctggaagaggagcctgacctcaacttcagcaaagaaaattacgatgagaacctggaaaactttcttggctctctggaggaagacttctccgatgtctttgccaagctcaaagttctgagagacacgatccttctgagcgggatgctcacctatacaggaaccacacgggctagattctccgccaccatggtggagcgctacgaggaacaccggaaggatctgcagagatttaaatctttcgtgaagcaaaatctgagcgagcaggactatctcgatatctttggccgcaagacgcccaacgggttcgacgtcgacaaagaaacaaagggatacgtgggctatatttccaataaaatggttctgaccaaccctcagaagcaaaagacaatccagcagaatttttacgattacattagcgggaagatcaccggaattgagggcgctgaatatttccttaacaagatctctgacggcaccttcctgcggaaactcagaacaacggataatggggccgtgccgaaccagatccacgcgtacgagctggagaagattatcgaccgccaaggagaagattatccctttcttctggagaataaagacaagctcctgtccattctgaccttcaaaatcccttactatgtcggccccctcagcaaggggaacaattctcggtttggatggattaaaagaacaatcagccaggatattctggacgataacgacgaagatacccgcaatggcaagatccggccttggaactaccagaaacttatcaatatggacgagacaagagatgccttcattaccaacctgatcgggaacgacattatcctcctgaatgagaaagtgctgcccaagcgctcccttatttatgaagaggttatgctccagaacgaactgacgcgggtgaaatacaaggacaaatacggaaagacacactttttcgattctgagctgagacaagaaatcatcaataacctctttaagaccaataacaaacgggtcagctccgctatgctgcttgactatctggagaattacaccaacctccaggccgtggagattgtcagcggcatcgaaaagggcaaatctctcaattccacactgaagacctataacgatcttaaaacaattttcagcgaggaactcctggactctgagatctaccagaaggaactggaggagattgtgaaggttatcacggtgtttgatgacaaaaagtccatcaaaaattatctcattaagtacttcgggcacctggaatttcttaacgaggaacgcatcaatcagctgagcaaactcagatataccggatggggccggtactccgctaagctgctgcttgatattagagacgaggatacagggttcaacctcatgcaatttctgcgcaatgacgatgaaaaccggaacctgtctcagctcatcagcgactccaccctgtctttcgatagcgccattaagtccatccagagcaaatctacagtcgaggacgacgtgttcgatgagatcaagaaacttgccggatccccggctattaagagaggcatcctgaatagcattaaaatcgttgacgaactcgtgcagattatcgggtaccctccccaaaacattgtcatcgagatggcgcgcgaaaatatgaccacggaggagggccagaagaaagccaagaccagaaagacaaaactggaatctgctctgaagaacatcgaaaattccgtgcttgaaaacggaaaagtgcctcatagcgatgagcagctccaatctgaaaagctgtatctgtactatctccagaatggcaaagacatgtacagcctggataagaccgggtcccccacacccctttatcgggaccagctggatcagtacgaggttgaccacattatcccttatagctttctcccgattgattctatcgacaacaaggtcctgacccaccgcgagaataaccaaagaaaactgaataacattcccgataaggaaacggtggccaatatgaaacctttctgggagaaactttacaacgccaaactgatctcccagacaaagtaccagcggctcaccacaagcgaacgcacccccgacggagtgctgaccgagtccatgaaggctggctttatcgaaagacagctcgtcgagacacggcaaattatcaaacatgtggcccgcattctggacaatagattccttgatacgaagatcattgcgctgaaatctcagctcatcaccaactttcggaacacattccacatcgctaagattcgcgagctgaatgactatcatcacgcccatgatgcctacctggctgttgtggtcgggcagacccttctgaaagcctatcctaagctcgctcccgaactgatctacggacaccacgcccattttaacagacacgaggaaaataaggcgacaattcggaaacatctctatagcaacatcatgagattctttaataacccggactccaaggtgtctaaagatatttgggactgcaatcgcgatctgcctatcattaaggaggttatctacaacagccaggtgaatttcgtcaaacggaccatgatcaagaagggcgccttttataaccaaaatcccgtggggaaattcaacaagcagattgctgccaataacagataccctcttaaaacgaaggtttcctctctggacacaagcatctacggcggatatggccccatgaactccgctctcagcattatcattatcgccgaacgcttcaatgagaaaaaggggaaaatcgagaccgtgaaggaatttcacgatattttcatcattgactacaagaaatttaataacaaccctttccagtttctgaatgatacctctgagaacggattcctgaagaaaaataacatcaatcgggtccttgcgttttatggcgtgcccaagtactccctgatgcagaaaaacgacgggacaagaatgctgttcgaaagcaagtctaatctgcacaaggccacccaatttaaactcacaaagacgcagaacgagctgttctttcatatgcgccggcttctgaccaaatccaatctgatggatctcaagagcgagtctgctattaaagaatcccagaacttcatcctgaagcacaaggaggaatttgacaatatcagcaaccaactttccgccttcagccagaaaatgctgggagacacaacctctctcagaaatctgattaagggctataacgagcgcaaaatcaaggaaattgatagctccgaggaggtgatcaaatacttctatgacaattttattaagatgttctcttttgtcaagagcggggctccgaaagatatcaacgacttctttaacaataagtacacagttgcccggatgagacctaaacccgataagaaattcctcaacgccaccctgattcatcagtccatcacgggcctttacgaaacccggatcgacctgtctaagctgggagaggattga

SEQ ID NO: 4484 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgaggattacagagtgcccgcctttaagttcaaagtcctcggcaacacagaaaaggagaaaatcaagaagaatctgattgggagcacgacctttgtgcctgcgcagtccgctcaaggaacacgggttttccgcgtgaacagacggcgcatcgacagacggaatcaccgcattgcctatcttagagatatctttcagaaagaaatcgagaagattgacaaaaacttctaccggcgcctggatgaatcttttagagtcctcggcgacaagagcgaggatatccagattaaacagccgttctttgggaataaggagctggaaaccgcctatcataagaaataccccacaatctatcaccttcggaagcatctggctgacgccgataaaaactcccctgtggctgacattcgcgaggtttacatggtgctctctcacatcctgaagtacagaggacatttcctgaccctcggcaaaattgatcccaataacatcaatatgcaaaacagctggatcgactttattgaatcctgccaggatgccttcgacctggagatcagcgacgagtctaagacaattgcggccatctttaaatccagcgaaaatcggcaggagaaggtcaagcagattctttcttatttccaacaggaactgctcaaaaaggataaatccatcttcaagcagctgcttcagctgctctttggcctgaaaaccaagttcaaggactgttttgagctggaagaggagcctgatctcaacttcagcaaagaaaattacgacgagaacctggaaaaccttctgggggctctcgaggaagatttttctgacgtgttcgccaagctgaaaatccttcgcgatacgattctgctctccagcatgctgacctatacaggagctacccacgccagattttccgcgacaatggtggagcggtacgaggaacacagaaaggacctgcaacgcttcaaatcttttgtcaagcagaatctcagcgagcaggattatctggacatcttcggccggaagacccccacggggtttgatgttgacaaagaaacaaagggatacgtgggctatatttccaacaaaatggtgcttaccaatcctcaaaagcagaaaacaatccagcagaacttctacgactacattagcgggaagatcaccggaatcgagggcgccgaatgctttctgaataagatttctgatggcaccttcctcagaaaactgcgcacaacggacaacggggctatcccgaatcaaattcatgcctatgagcttgagaagatcattgaacggcagggaagagattaccccttcctgctcgagaacaaagacaagctgctgtccatcctcacctttaaaattccttattacgtcggccccctggctaaggggaataacagccgcttcgcctggatcaaacggacaacctctcaggatgtgcttgacgataatgacgaagatacaagaaacggaaagatccgcccttggaattatcacaagctgattaacatggacgagacccgggatgcctttatcattaatctcatcggcaacgacattatcctgctgaacgagaaagttcttcccaagagaagcctcatctacgaagaggtgatgctgcagaatgaactgacgcgcgtcaaatataaggataaatacgggaagattcatttctttaactccgagctccggcaagaaatcattaataacctgttcaagacaaattctaaaagagtgagctccgctatgcttctgagctacctcgagaactttaccaatctgcaggcggttgagatcgtgtctggaattgaaaagggcaaatccctgaacagcacccttaagacatataatgacctcaaaaccatcttctctgaggaactgctggactccgagatctaccagaaggaactcgaggagattatcaaggtcattacagtgtttgatgacaaaaagagcatcaaaaactatctgacgaagtacttcggccaccttgaatttctgaatgaggagaaaattaaccagctctccaagctgcggtataccgggtggggacgctactctggcaagctgcttctcgggatcagagatgaagacacaggattcaatctgatgcaatttctgcggaacgatgacgaaaatagaaacctcacccagctgatcagcgatacaaccctttccttcgactctgccattaaagctatccagagcaagtccacggtcgaggatgacgtgttcgaggaaattaaaaacctggccggcagcccggccatcaagcgcgggattctcaattctatcaaaattgttgatgagctggtgcagatcatcggctatcctccccaaaacattatcattgaaatggctcgggagaatatgaccacagaggaaggacagaagaaagccaagaccagaaagtccaaactggagagcgcgcttaagaacatcgaagactctgtcctcgagtccggcaaagtgcctcacagcgatgaacagctgcaatctgagaagctgtacctctactatctgcagaatgggaaagacatgtacagccttgacaagacaggatcccccacgcccctgtatcgcgatcagctcgaccagtacgaggttgatcatattatcccttatagctttctgccgatcgactctattgataacaaggtgctgacccacagagaaaataaccaacggaaacttaataacatccccgacaaggagacagtcgctaatatgaaacctttctgggaaaagctgtacaacgccaaactcatttcccagaccaagtatcagcgcctgacaaccagcgagagaacccccgatggcgtgctcacagaatccatgaaggccgggtttatcgagcggcagctggtggagacgcgccaaattatcaaacatgttgctagaatccttgacaatcggttctctgataccaagattatcacactgaaaagccagctcgtcaccaactttcgcaatacattccacattgccaagatcagagaactgaacgactaccatcacgctcacgatgcctacctggcggtggtggtcggacagacccttctgaaagcctatcctaagctcgctcccgagctgatttacggccatcacgcccattttaaccggcacgaagagaataaggctacgctccgcaaacacctgtattccaacatcatgagattctttaataacccggactctaaggtgagcaaagacatttgggattgtaatcgggaccttcctatcgttaaggatgtgatctacaactcccagattaatttcgtcaaaagaacaatgatcaagaagggggccttttataaccaaaatcccgtgggcaaactgaacaagcagattgcggccaataaccgctaccctctcaaaaccaaggtttctagcctggacacctccatctatggaggctacgggcccatgaatagcgctctgtctattatcatcattgccgaacggttcaacgagaaaaagggaaaaatcgagacagtgaaggaatttcatgatatttttatcattgactacgagaagttcaataacaatccttttcagttccttaacaacgtctccgaagagggctttctgaaaaagaatgatctcaacagagtgctggctttctatcgcatcagcaaatactctctcatgcaaaagatcgacgggacccggatgctgtttgagtccaaaagcaatcttcacaaggttacacagttcaagctgacgaaaacccagaacgaactgtttttccatatgaagagactcctgacaaaatctaatcttatggatctgaagtccgagagcgccattaaagaatcccagaactttatccaaacccaccagaatgagttcgacaacattgccgatcgcctcagcaattattctcagaagatgctgggagaaacaaagagcctccagaccctgatcaacggctacaatgagcggcccattaaacaaatcgacaacaatgaggaaacgattagatattactatgataactttatcaagatgttctccttcgtgaaatctggggctccgaaggacatcattaatttcttcaacgacaaatacaccgtccctcgcatgcggcccaagcccgatagaaagatgcttgacgcgacactgatccatcagagcattaccggcctgtacgagacacggatcgatctctccaaactgggagaagactga

SEQ ID NO: 4485 - RNA, 4263 nt, synthetic construct
  misc_feature 1..4263: note = Cas9 variant
  source 1..4263: mol_type = other RNA
atgagcagaaagaactacgtggacgattatgccatctccctggacattggcaatgcttctgtcgggtggagcgccttcacccccaactaccggctcgttcgcgcgaaaggacacgagctgatcggcgtgagactttttgatcctgctgacacagccgaatcccggcgcatggccagaacgacccggcgcagatattctcggcgcagatggcggctgcgcctcctggatgctcttttcgaccaggccctgagcgagattgatccgtcctttctcgctagacggaagtactcttgggtgcatcccgacgatgaaaataacgccgactgctggtatgggagcgtcctgttcgattccaatgagcaagacaaacgcttttacgaaaagtatcctacaatctaccacctgagaaaagcgctcatggaggatgacagccagcatgacattcgggagatctacctggccatccaccatatggtgaagtatagaggaaacttccttgttgaaggcaccctggagtcttccaatgcttttaaggaagatgagctcctgaaacttctggggcgcattacacggtacgagatgagcgaaggagagcagaactctgacatcgaacaggatgacgagaataagctcgtggcccccgctaacggccaactggccgatgcgctgtgtgccaccagaggctcccgcagcatgcgggtcgacaatgctctcgaagccctgtctgctgtgaacgatctttccagagagcagcgcgccattgttaaagccatcttcgctgggctggagggaaataagctcgacctggcgaaaatttttgtgagcaaggagttctcctctgagaacaagaaaatccttggcatttattttaataagagcgattacgaagagaaatgcgtccagatcgtggactccgggctgctcgatgacgaagaacgggagttcctggacagaatgcagggacaatataacgccatcgctctgaagcagctcctgggccgcagcacatctgtgtccgatagcaaatgtgcctcttacgacgcccaccgggctaactggaatcttattaagctgcagctcagaaccaaagaaaacgagaaggatatcaatgaaaactatgggattctggtcggatggaagatcgacagcggccagcgcaaatccgttcggggcgagtctgcctacgaaaatatgagaaagaaagcgaacgtgtttttcaagaaaatgattgagacgagcgatctttccgagaccgacaagaatcggctgatccacgatatcgaagaggacaaactcttccctattcaacgcgatagcgacaacggggtgatcccccatcagctgcaccagaatgaactgaagcaaattatcaagaaacagggaaagtactatccttttctcctggatgctttcgagaaagacggcaagcagattaacaagatcgaggggcttctgacatttagagtcccgtacttcgtgggacccctcgttgtgcctgaagatctgcagaaatctgacaattccgagaaccattggatggtccggaagaaaaagggcgaaatcaccccctggaattttgacgagatggtggataaagacgccagcgggagaaagttcattgaacgcctggttggaacagattcttatcttctcggcgagcctaccctgcccaagaactccctgctctaccaagagtatgaagtgctgaatgagcttaacaacgtccggctgagcgtgagaacgggcaatcactggaacgacaaacgcagaatgcggctcgggcgcgaagagaagacactgctgtgccagagactttttatgaaaggacagaccgtcacaaagcggaccgccgaaaatctcctgcgcaaagagtacggcagaacctatgagctgtccgggctctctgatgaaagcaagttcacatcctctctgagcacgtacggaaaaatgtgtcggatctttggcgagaagtacgtgaacgaacaccgcgaccttatggagaagattgttgaactgcagaccgtgttcgaggataaagagacactcctgcatcaactgagacagcttgaagggatctccgaggctgactgcgccctcctggtcaatacccactatacaggctggggacggctgagccgcaagctcctgaccacgaaagctggcgaatgtaagatttctgatgactttgccccgagaaaacattccatcattgagatcatgcgggcggaggatagaaaccttatggaaatcattacagacaagcagctggggttcagcgattggatcgagcaggaaaatctcggagccgagaacgggtcttccctgatggaagtggttgacgacctgcgcgtgagccctaaggtcaaacggggcattatccaatctattagacttatcgatgacatcagcaaggctgtgggaaaacgcccctcccggatttttctcgagctggccgatgacatccagcctagcggcagaaccatttctcgcaagtcccggctgcaggatctctacagaaatgctaacctggggaaagagttcaagggcatcgccgacgaacttaatgcgtgcagcgataaggacctgcaggatgaccgcctcttcctgtattacacccaactgggaaaagatatgtatacaggcgaggaacttgacctggaccggctctcctctgcctacgatattgaccacatcatcccccaggctgtgacccagaacgatagcattgacaatagagttctggtcgcccgggctgagaacgcccgcaagacagattcctttacgtatatgccccaaatcgccgacagaatgcggaatttctggcagattctcctggataacgggcttatctctcgcgtgaaatttgaaagactgacccggcagaacgagttcagcgagagagaaaaggagcgctttgtgcagcggtccctcgtcgaaacaagacaaattatgaaaaatgtggctaccctgatgcgccagcggtacggaaactctgcggccgttatcggcctgaatgctgagcttacaaaggaaatgcatagatacctggggttcagccacaagaaccgcgacatcaatgattatcaccatgcccaggacgccctctgtgtgggaattgctggccagtttgccgcgaaccgggggttctttgctgatggcgaggtctccgacggagcccaaaatagctacaaccagtatctgagagattacctccgcggctatagagagaaactgtctgccgaagaccggaagcaggggcgcgctttcggatttatcgtgggctccatgagaagccaggacgagcaaaaacgggttaatcctcgcaccggggaagtggtctggtctgaggaggataaggactaccttagaaaagtgatgaactatcggaagatgctggttacgcagaaagtgggagatgacttcggcgccctctacgatgaaaccagatacgcggctacagacccgaaggggattaagggcatcccctttgatggagccaaacaggacacctccctgtatggcgggttcagctctgccaagcctgcttacgccgtcctgattgagtccaaaggaaagacacgccttgtgaatgtgaccatgcaagaatatagcctgctcggcgatcggccctccgacgatgagctgagaaaagtcctcgctaagaagaaaagcgaatacgccaaggcgaacatcctgcttcgccacgttcctaaaatgcagctgattcggtatgggggaggcctgatggtgatcaagtctgccggcgagctcaataacgctcagcagctgtggcttccctacgaggaatattgctacttcgacgatctgagccaagggaaaggatccctcgagaaggacgacctgaagaaactcctggattctatccttggcagcgtgcagtgtctgtacccgtggcatagatttacggaagaggaactggccgacctccacgtcgctttcgataagctgcctgaggacgagaaaaagaatgtgattacagggatcgtttccgcccttcacgccgatgctaaaaccgcgaacctgtctattgtgggaatgacaggcagctggcggcgcatgaacaataagtccgggtataccttttctgacgaagatgagttcatctttcagagcccctccggactcttcgaaaagagagtcaccgtgggcgagctgaaacggaaggccaaaaaggaagttaacagcaaataccgcacaaatgagaagagactccctacgctgtctggcgcttcccagccctga

SEQ ID NO: 4486 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttacggacgatcagaataacatcctcagaattaagggcaaaaaggctatcggggcccggctgttcgcggagggaaaagtggctgccgaacgcagatcctttcggaccacacgcagacggatttctcgcagacggtggcgcatcaaacttctggaggaactcttcgacgaggaaatcgccaaggtggatcctagctttttcgctagactgcacgagtcctggatttctccgaaagacaagcggaaacgctatagcgccatcgtctttccctcccctgaggaagataagaaattccatgagtcttaccccaccatttatcaccttagagacaagctgatgaaggatgaccaaaaacatgatatccgggaaatttacatcgctgtgcaccagatgattaaggttcgcggcaattttctccatgacgagagcgtggagacatatagatccgggatgagctctctgggaggccggtccgaaagaaccatcctgagcgtccagacactcgaggaactgaacgatcttttcgccgagaatgaaggcaccgaggaggtggaactgaacgttgcgtctgccgagcagatcaatgacattctcacgggggaccacctgaacgctgattcccaaaaagaaatcagcaatcttctgctcccttcttcctttcccagcttcgacgataaggccaaagagaaacaggtgaaaaagctgattaacaatgtcgctaccaacatctccaaggcctggctgggatacaaagcggacttttctacaattctcaatctggccaaggtggataaagaccagaagaaaatcttcgcttttgcccttcagggcggggatgaagaggacaaggtgcaagagctggaaagcctcctggagcagtcccagaccgatatcgtcgaccgccttattgaaatccggcacgctattgttctgagcgagatcgtgcctgtgggaatgacactctctgaagccatgattgataagtatgaccagcataaagaggacctgatcaccctgaaggccgtcatcagaaacacgaaagataagaaaaaggctgcgaagctccaagccatttacgacctgtacgtgaataaccgccacgctgatcttgccaaagccatgaagctgacaggcatcaaaaagcggtccgagctcctggacccggaggaacttaaaaaggctattagctctctgctcgatgacagccccgaagccggggagatcaagcagagactggagggaaaaaccttcctgcctctccagcgctccaacaataacggcgttattcccaatcaactgcatcaggtggaacttgatgagatcattaagaaacagtctaagtattaccctttcctggcggaaaagaaccccgacgagagcgaagaggctcagaagaaagccccgacaaagctcgatgccctgctgacctttcgggtcccttattacgtgggccccatgatcaccaaggaggaacaagaggctcaggacgggcactccttcgcctggatggttagacgcgatcctcaggaccacgaagctatcacaccctggaattttgagaaaaaggtggataaaatggccagcgcgacgcagttcattaagcggatgaccacaaaagacacctatcttctcggagaagacgtcctgcccgcctcttccctgaagtaccaactctttacagtgctgaacgagcttaataacctgagagtcaatggcaagaaactcaccagcgatgagaaggaacaggtgatcgaggggctgttcaaaaagcagaaaacggttaaggctgacaagtttgtgaaatattggcaggccattcatatcggagctgatattaaggtcaaaggcctgtctgacccttccaagttcaacagcacaatgtccacctacatcgattttaaaaagatcttcggggaccaacttaatgatgccaaccgccagaatgactttgaaaagattatcgagtactctaccattttcgaagatcggaaaatcctcgaggacaagctgagagcggattttgcctggctgagcgaggaacagattaaacagctctgccggctgcgccttcaaggatggggcagactgtccgacaagctcctgacacggctgaccgatgctgacggccagaacgtgcttgagagactctggaatagcaacgacaacttcgttcagatcgtgagcgatccgaatatcaaagccaagattgaacaagagaaccagaaactgctgcgcgacgggcagtccgatgacgctgtcgagagcatcctcgatgacgcctatacatctccccagaataagaaggccattcggcaagtgatgagagtggttcacgatatcgtcaaggcttgtgacggaaacgtgcctgcgaagttcgccattgaatttgctcgctcccaggaggatgaccccaaaagaacgaccgcccgggtgaatcagatgcagaagatctacgatcaaatcagcgacgaagtcgtgtctcagggcgttaaagagcagctgtccgggatgaaaagccttaaggaccgctattacctgtatttcatgcagggaggcagagatgcctacacaggggctaagctcaacattgaccggctgtctgattatgacatcgatcatattatgcctcaatcttttgtgaaggacgattccctggacaatcgcgtccttgtggccagagcggttaacaatcagaaaagcgataaggtgcccgctttcctctttggcaacaaagtcgtggccgacctgggaatcaccgttcgggaaatgtgggataagtggcagaagctgggcatgatttctaaacgcaagctctccaatctgcttacagacccggatgccctgaccgagtacagagctcaagggttcatccggcgccagctcgtggagacgagccaggtcattaaactgaccgccacaatcctgcagtccgaatttcctgactctaagatcattgaggtgcccgcgaaatacaacagcatcgtgagaaagcaattcgacctttataagtcccgggaagtcaatgattttcaccatgctattgacgcctacctgtctaccatcgttggaaactatctctaccaggtgtatcctaatctgagacgcatgttcgtgtacggcgagtttaaaaagttcagctccaacgccgaagagtctgctcacgatatggcccggagagtcaaaagcatgaactttctcgacgatctgcttcgcgggacacacggagacaatatttattgccggtccaccggcgagatcgtgttcaacagaaatgatatcattagcaagctgaaacaggcttactctttcaagcagatgctcgttacgcaagaagtgtttacacgcaagtccgccctgttcgaccagaccgtctaccccagccctgagcgggattctaaaaagagatccgggctgatcccccgcaaaaagggcatggacacagaaatttatggaggctacagcgggaacaaagatgcgtattttgtgcttgccgaggctgttaaggaaaaaggacataccctgcagatcgtgggcgtcccgattcgggccctcaataccctgaagaactctgctaattactccgagaagctcctggagatcatcaaacctcaggtgatgttcaacaagaaaaatgggaagcccaaaaagggagttaacgacgtgcggattcttatggataatatcccctatagacaacctgtcctggaaggcggggccctctacatgctgggcagctccacatataagtacagcctgaaacagattacgctttctcaggagagcatgaagtacatcctggactatattgacgatccgtcctttaacaaacacatcatggtgaatattgaccatcaggatgaaaagaaatgtctcctgtctgtgtacgacgagatcctcgataagatggacaagtatctgccccttttcgatatcaacggatttcgcaaaaagctgcacgacggcagagagaaattcgtcaagctgcctgttgaaaaacaagccgaggtggtgaaggatattctccgggggctgcacgctaatagcgaaatgaccaagccctccgaccttggactgacaaccgcgctcggctttatgcaggcccctgatgggatcaaaatttctgacgacgctgtcttcatctaccagagccccacaggactgtttgagcgcagagtgaaggtttccgatctcctgaaatga

SEQ ID NO: 4487 - RNA, 4266 nt, synthetic construct
  misc_feature 1..4266: note = Cas9 variant
  source 1..4266: mol_type = other RNA
atgaccaagttcaacaaaaattacagcatcggcctggacattggggtgtcctctgtcggatatgccgttgtgacagaggattacagagtgcccgcttttaagttcaaagtcctcggcaacacggaaaaggagaaaatcaagaagaatctgattgggagcaccacatttgtgtccgcccagcctgcgaaaggaacccgggttttccgcgtgaacagacggcgcatcgacagacggaatcaccgcattacatatcttagagatatctttcaaaaggaaatcgagaaagtcgacaagaacttctaccggcgcctggatgaatcttttagagtgctcggcgacaaaagcgaggatctgcagattaagcagccgttctttggggacaaggagcttgaaaccgcttatcataaaaagtaccccacaatctatcatctgcggaaacacctcgccgatgccgacaagaatagccctgttgctgatattcgcgaggtgtacatggccatctctcacattctgaaatacagaggacatttcctgaccctcgacaagatcaaccccaataacattaatatgcagaacagctggatcgattttatcgaatcctgccaagaggtcttcgacctggagattagcgacgaatctaaaaatatcgctgatatttttaagtccagcgagaaccggcaggaaaaggtgaaaaagatccttccttatttccagcaggagctgctcaaaaaggacaaatctattttcaagcaactgcttcagctgctctttggcctgaagacgaaattcaaggattgttttgaactggaggaggaacccgacctcaatttctccaaagagaactacgatgaaaacctggagaattttcttggcagcctggaagaggacttctctgatgtgtttgccaagctcaaagtcctgcgcgacaccatccttctgtccgggatgctcacatataccggagcgacacacgccagattcagcgctaccatggttgagcggtacgaagaacacagaaaggatctgcagcgctttaagttctttatcaaacagaacctgtccgaacaagactatctcgatattttcggccggaagacgcagaatgggtttgacgtggacaaagagacaaagggatacgtgggctatatcaccaacaaaatggtcctgacaaatcctcagaagcaaaagaccattcagcagaacttctacgattacatctctgggaaaattaccggaatcgaaggcgccgagtatttccttaataagatcagcgacggcacatttctgagaaaactccgcacgtccgataacggggctattccgaatcagatccatgcctacgagctggaaaagattatcgagcggcaaggaaaagactatcccttccttctggaaaacaaggataaactcctgagcattctgacctttaagatcccttactatgtgggccccctcgcgaaggggtctaattccagattcgcctggattaaacgcgctacaagctctgacatcctggatgacaacgatgaggacacccggaatggaaagatcagaccttggaactaccagaaacttattaatatggatgagacacgcgacgcctttatcaccaacctgattggcaacgatatcattctcctgaatgaaaaggttctgcccaaacggagccttatctatgaggaagtgatgctccagaacgagctgacgagagtcaagtacaaggacaaatacgggaaggctcacttctttgactccgaactgcgccagaatatcattaacggactcttcaaaaataactctaagcgggtgaatgccaaaagcctgatcaagtatctttccgataaccataaggacctgaatgccattgagatcgttagcggcgtggagaaaggcaagtcttttaactccacactcaaaacctacaatgatctgaagaccattttcagcgaggagctgcttgactctgaaatctatcaaaaagagctcgaagagatcattaaggtcatcacagtgtttgatgacaagaaatccattaagaactacctgaccaaattctttgggcacctggagatcctcgatgaagagaagattaatcagctgagcaaacttagatattccggatggggccggtactctgctaagctgctcctggacatccgcgatgaagacacagggttcaacctgcttcagttcctcagaaatgatgaggaaaaccggaacctgacgaaactgatcagcgacaataccctctcctttgagccgaagattaaggatatccagtctaaaagcacaattgaggacgacatcttcgatgaaattaagaaactggcgggatcccctgccatcaagagaggcattcttaacagcatcaaaatcgtcgacgagctggtgcaaattatcgggtatccccctcacaatattgttatcgaaatggctcgcgagaacatgaccacagaggaaggccagaagaaggccaaaacccggaagacgaaactcgagtctgccctgaagaatattgaaaactccctgcttgagaatggaaaagtgccccatagcgatgaacagctccagtctgagaagctgtacctgtactatctccaaaacggcaaggacatgtacaccctggataaaacagggtcccccgctcctctttatctggaccagctcgatcagtacgaggtcgaccacatcatcccgtatagctttctgcccattgattctatcgacaataaggtgctgacccatagagaaaacaatcaacagaaacttaacaatattcctgataaggagacagttgccaacatgaaacccttctgggaaaagctgtacaatgcgaagctcatcagccagaccaaatatcagcgcctgacgacatccgagagaacccctgacggagtgctcacagaaagcatgaaggctggctttattgagcggcaactggtcgagacccgccagatcatcaaacacgtggcccggattcttgacaacagattctctgataccaagatcattacactgaaatcccagctcatcacgaactttcgcaataccttccatattgccaagatcagagaactgaacgactaccaccacgctcatgatgcctacctggctgtggttgtcgggcagacacttctgaaggtgtatcccaaactcgccccggagctgatttacggacaccatgcgcactttaatcggcacgaagagaacaaggccaccctccgcaaacatctgtatagcaatatcatgagattctttaacaatcctgactccaaggtgtctaaagatatctgggactgcaaccgggatcttcccattatcaaggacgtcatttacaatagccaaatcaacttcgtgaaacgcacaatgattaagaagggcgctttctataatcagaaccctgttgggaaatttaataagcagctggccgctaacaatagataccccctcaaaaccaaggccctgtgtctggatacgtccatctatggcggatacggccctatgaactctgcgcttagcatcattatcattgccgaacggttcaatgagaaaaaggggaagatcgagacagtgaaagaatttcacgacattttcatcatcgattacgagaagtttaacaacaatcccttccagtttctgaacgacacctccgaaaatggattcctcaaaaagaacaatattaacagagtcctgggcttttatcgcatcccgaaatactctctcatgcaaaagattgatgggacccggatgctgttcgagagcaagtccaatcttcataaagctacacagtttaagctgaccaaaacacagaacgagctgttctttcacatgaagagactcctgacgaaaagcaatcttatggacctgaagtctaagtccgccatcaaagaaagccaaaacttcattctcaagcataaagaggagttcgacaatatctctaaccagctgtccgcttttagccagaagatgctcggaaataccacatctctgaaaaaccttattaagggctataatgaacgcaaaatcaaggaaatcgatattcgggacgagaccatcaagtacttctatgataactttattaaaatgttctcctttgtgaagtccggggcccctaaagacatcaacgatttctttgacaataagtgcacagttgccagaatgcgccccaaacccgataagaagctgctgaacgctaccctcattcaccagtccatcacgggcctgtacgagacccggatcgaccttagcaaactgggagaagattga

SEQ ID NO: 4488 - RNA, 4266 nt, synthetic construct
  misc_feature 1..4266: note = Cas9 variant
  source 1..4266: mol_type = other RNA
atgaagaaaatcctgggcctcgacctggggcccaacagcattggatgggcccttgtgaatgaggctgaaaacgagaatgaaaagtcctctatcattaaaatcggcagcagagtcattcactacggggataacctggttaaggtggacaaatccggaaagatctctgccagcatgacccctgaggaagatttctcctctggcaaggggctcagcccgaatgcgggacggacaaaacagcgctccgctagacggaacctgcaacgctataagcagagacggaataaccttatcgagattctgaaagcccatagcctcatcgacaataactttattttctctgaggaaggcaatgagacgacctttaagacatacaaaaaccgcgccctggctgccaccaatgaaatctccctggaggatttcattaaggtgctctttatgatcaacaagaaaagaggctataagagctctcggaaagctaagggggacgaggatggacagctgattgacggcatggccatcgcgatccagctttacgaacacaatcaaacacccgggcagttcgtctataacctgctcaaaaacggaaagaaaaatattcctgatttttaccgctccgacctgcagaccgagttcgatagaatctggaactttcagaaggccttccatcaagaaagcctttctgacggcatttgcgagaagctggtggggcagaaaaagaatgttacatccgctatcctctttaaagagttcaagattgaaagcctggagatcaaaggaaagtgggatgaaaagcggtttttccgctatgagctgagaaacaaagccgtgcagcaggaactcaagctgaatgagatcgctgaatgtcttgtcgagattaacggcgagatctccaattctagcggctacctgggggccatttccgaccggagcaaagaactcgtgttccaaaagatcaccgttggacagtacctgtataaacagattgcggccaaccccaatacgtctcttaagaagcaaatcttttaccgccaggactatctggatgagttcaacaccctctgggaaacacaggctaaataccacaaggagctgaccgacgaactgaaaacacagatcagagatgtgattatcttttatcaacggagactcaagtcccagaaaggcctgattagcttctgcgagtttgagtctaagcagatcgaagtcttcgtggacgggaagaaaagcattaagacccgcggaatgcgggtgatccctaaatcctctcccctttttcaggagttcaagatttggcaaatcctgaataacatcgaaattacggatctcaaaacaaaggagagcagagagctgaccgacgatgaacgccagcttctgtttgaggaactcaatatccggcctaaaatttccaagaaggaggccctgaaaatcctgacagaaaagccggctcagtacgacctcaactataaagatattgagggcaataagaccaacgccaaattctacgaggcctacaacaagatcatccatctgagcgggcacgacgaaattgattttaccgacaagacatctgacatcaatgagtatcttaaacagattttctccctgctcggaatcaagcccgaaattctggattttgacagctctctgaaagatgaggacttcgaaaagcaacttcacttccagctctggcatctgctgtactcctttgagggcgataacacgaaaaccggcgacgagaagctcctgcagaaacttaatacaaagttcgggtttcctgtcgaatatgctaaggttatcagcaacatcgcgctgcccgatgactacggatccctctctgccaaagctattagaaagatcctgcctcacctgaaagatggcttcagctatgggggacgcaagtcccggcccgacgagccgtctgcctgtgaatacgccggctatagacatagcaaggcttcccttaccaaagatgagaaggaaaataaaacatacaaggacaaactcgagattctgcctaagaacagcctgcgcaatcccatcgtggagaaaattctcaaccagaccatcaatgtggtcaacgccgtgatcggggattacggcaagcctgacgaaattcggctggagcttgcgagagaactgaagaaatctgctgaggagcgccaagacgccacggattccatcagcaaggccacagctaaacacgaaaagtatcggaaagttctccagaccgagtttggactgaagcacatttctagaaatgacctgatccggtacaaactttatctcgaactgaagaacaatggcttcaagaccctgtactccgatacatatattgccccctacgagatctttagcaaaaagttcgacattgaacatatcctccccaaagctaagctgtttgatgactctttcagcaacaagacccttgagctgaaatccgtgaatctcaagaaaggggatatgacagcctatgactttgtcaaggaggaatacggaacggagggcctggcgaaatacgaacagcgcgtgcaagatctgttccttaacaagaagagaaacgaggacctcgatcaggaaaatgagagccggatcaccgacgagaaaatttctaagacaaaaagagataagctgctgatgcctgaaaacaaaatcccgaccgggtttattgaccgcgagctccgggactcccagtatatcgccaagaaggctaaaacaatgatggaagatatttgcaaggacgttgtgaccacgaccggaagcgtcacagatagactgcgcgaggactggcagcttatcgatatcatgcaagaactgaattggcccaaatacgccgctctcggcctgaccgaggagttcacaaacgaagaggggaatgtgattagaaagatcaaagactggaccaagcggaacgatcaccgccatcacgccatggacgcgattacgatcgccttcacaaaaagatcccatattcagtatctgaataacctttctgctcggagcgataagtcctctagcatctacggcatcgaacagaaggagctgtatcgcgacaaaaataacaagctcagatttgcccctcccattcctatcaatgagttccgggctgaagccaaaatgcagctggagaacaccctcatttccatcaaggcccaaaataaagtcgtgacaaagaacaagaataaaatttctggacagaagaaactgcaggaaacccttacaccccgcggccagctgcacctcgagaccatctacgggaagattaaccaatatcagacggctgaaatcaaagttggaggcaccctggatagcgagctgatcaacaaggtggcgaataagaaaacaagagaggcccttctgaaccggctcgctgaatttgggaatgacccgaagaaagccttcaccgtcaagaacacaattgacaaaaatcctatctacctggataagcaccagtcctacaagattcccgagaaagtgaagatcgtttggcaagaacctgtgtataccattcgcaaaagcatcacgcccgacctcaagctggataaaatcattgaccctaagatcaaagcccttctggagtctagactcaaggaatgtaacggagatgctaagctggccttttccaatctggcggagaaccccatttggcttaataaagagaagggcatccagattaaacgggtcacaatcaccgggatcagcaacgctgcctctctgcatgacaagaaagatctcaatggcaagccgattctggacgaaaagggaaacaaaatctccgtggatttcgtgaataccggcaacaatcaccatgttgccatttacaaggacgagaacgggaatctccacgataacgtcgtgacatttttcgaagctgtggagagagtcaaccagaatctgcctgtggttgacaaactttttaagcagaaagaaggatggcaattcctgtttaccatgaagcagaacgagtatttcgtgttccccaatgagatcacagcctttaaccccaatgagttcgatctgctcaaccctgacaattactatctgattagcccgaacctttttcgcgtccagacgatgtctaaggtgatgtacggcaataacaccctgcgggactataaattcagacaccatctcgaaacaaccctgcaggatatcaaggaactccgcgacattgtttttaaacaattcaagtccctgagcatctttgataaaatcgtgaaggtccggattaatcaccttgggaagatcgtgaaaacaggagagtactga

SEQ ID NO: 4489 - RNA, 4266 nt, synthetic construct
  misc_feature 1..4266: note = Cas9 variant
  source 1..4266: mol_type = other RNA
atgaaggacatcctgggcctcgatctggggaccaacagcattggatgggccgtggtcaaagaggctcagaatgacaacgaacaatccgagatcgttgatgtgggcgtgagagtcaatccccttacaacggacgaaaagaccaacttcgagaaagggaagcctatttctacaaatgccgatcggaccctgaaacgcagcgcgagacggaacctccagcgctacaagctgagacggaaggaacttatcgagctgctcaaagagcaccagctgatttccacagacaccatcctgacagaaaatggaaagggcaccacgtttcagaccctcgagctgcgcgctaaatctgccaaggagaaaatcagccttgaggagctggccagagtgttcctcacaattaacaagaagcgggggtataaatcctctcgcaaggctaaaaatgaagatgagggacaactgatcgacggcatggaaattgccaagagactttacgaggaaaacctgaccacaggccagctcagcctgcagctgctcaaagaggggaagaaatccctgccggattattaccggagcgaccttcagtttgagctggataaggtttggaatttccaaaagcagtttcattctcacatcctcaccgacgaattttatgctcagctgaaaggaaagggccagcgcgccacgtccgcgctttttctggccaaataccaaatttatacagctgagaacaaggggagcagagaagataaaaagctccaggcctaccagtggcgggtggacgctctgtctaaggagctgacccgcgaacaactcgccttcgtcatcacagagattaataacaatctgaacaactccagcggataccttggcgcgatctctgacagatccaaagagctgtattttaataacgaaaccgtgggggagtacctctggaagcagatcgccgctaatccccataccagcctgaaaaaccaggttttctatcggcaggattaccttgacgaatttgagcaaatttggaagacacagtccgccttctatcctgaaatcctgacggagtctctcaaaaaggagctgagagatgtggtcattttctaccagcgcaagctgaaaagccagaagtccctcgtgagcttctgcgagttcgaaaataaagaaatcgagattaagaaagaggacggaacctctacaaagaaggtgatcggcctgaaagtcgctcccaagtccagccctctttttcaagagttcaaaatctggcagaacctgaataacgttctcattcggaagaaaggctctaagaccaaaaaggccgccaagaatcagcaggctgtgctgtttgaagaagagaaaacaatcagcgaactggatcttgaggcgaagcaagccctcttcaacgagctgaatctgaaagggaacctcaaggctgactattgtctggaaattcttggatactcccccaaagagtgggaaatgaattactctgtgctggagggcaacagaaccaataaggccctctatgaagcctacctgaagatcacggatctggaggggtatgacgctaaaaaccaccttaaggtcaaactcaacaaggatgaggtggaactggacgatctgaaagttcctgccagcgagattaaggacatggtgcaggcgatctttaaggaagctggaatcaatacagacattctccatttcaacgccgagctggatggcaaagactttgaaaatcaggcctcctaccagctttggcatctgctctatagctacgagggggatgactctaagtccggaaacgagctgctgtataaacttctcgaaaccaagttcggctttaaaaaggagtacgctcaaatcctggccaatgtcagcctgtctgatgactacggctccctcagcaccaaggctatgcgcaaaattcacccgtatatcaaggaaaacaaattctccacagcctgcgagctggcggggtaccggcactctaagcacagccttaccaaagaggaaaatgataacagagtgctgcgcgactccctcgaggttctgaagaaaaattctctgcggcagcccgtggtcgaaaagattcttaaccagatgatcaatctcgtgaacgccctgctgaagaaatatagaacagagaatcctaactttaagttcgatgaaattcgcatcgagctcgctcgggagctgaaaaagaatgccgaagagagagctaacatgacggccaacatcaataaagcgaagaccgaacatgagaagattatcaaaattcttaagaacgaatttggactgcccaatcctacacgcaacgacatcattcggtacagactctatgaggagctgaaagccaatggctacaaggatctgtataccaacatcaaaatcccccaagaaaaacttttcacaaaggagattgacatcgaacacattatcccgaaaagccgggtcttcgatgactcctttagcaataagaccctgtctttccgcaaaacgaacctcgacaagggggagagaaccgcttttgattacatggaatccaaattcggagccgacaagctggaggagtacgtggctcgggttgaagatctctataagaataacattatcagcaaagccaagtaccagaaactgcttaagaaagagtctgaaatcggcgacgggtttgtggagagagatctgcgcgagacacagtatattgccaagaaggctaaagaaatcctcctgcagattacccctaatgtcctgtccacaagcggcggaatcaccgaccggcttagagaggattgggacctgattaacgtgatgaaggaactcaatctgcccaaataccgcgcgctcggcctgacggagatggaagatagaaagtatgggcaacaggttgaggtgatcatcgactggacaaaacggaacgatcaccgccatcacgccatggacgctcttaccgtcgccttcacaaagcataatcacattcagtacctgaactatctcaacgccagaaagaatgagaagcataaggaacactctaacatcatgggcattcagcaactggagaccatcaaagtgaccgataagaatggaaacgaaaaacgggtgtttaaggctcctatgcccaatttccgccaggttacaaaagcctttctggagaacattcttatcagccacaaggcgaagaataaagtcgtgacgaagaacaaaaataaggtggctgggtccaacaaagtccaggaagtgctgacccccagaggacagctccataaggagacagtttacggcaagtaccaatattacgtgcagaaagaggaaaagattgggggcaaattcgacctggagaccatcaagaaagtcgccaatcctctctatcagagcctgcttaagaagcggctggaagagaacggaggcgacccgaaaaaggcctttacagggaaaaattctctggctaagaaccccatctacctcgatgacgcccaaaccgaacagctgcctgagaaagtgaaacttgtttggctggaaaattccttcagcattcgcaaagatatcacgcccgaaaactttaaggacgagaagctcattgataaaatcctggacgaaggagtgaagcggattctcaaagagagactgcagtccttcggcaatgatgcgaagaaggctttctctgaccttgagaagaaccctatctggctgaacaaggaaaaagggatcacaattaagcgcgtcaccatcagcggagtggccaatgccgagcccctgcacaccaaaaaggatcatctcggcaaagaaattctggacaaggaggggaagccgatccctgttgattttatttccacaggctctaaccaccacgtggctgtctatagagacgaaaaaggaaatcttcaggagaaggtggtgagcgtcttcgaggccgttgtgcgggctaaccaaggcctgcccatcatcgacaaaacctacaatcagcatctcgggtgggaatttctgttcacaatgaagcagaacgagatgtttgtgttccctaatgaatccacgggatttaaccccaatgatattgacctcctggatcctaaaaacaagagaatcatttctcccaatcttttccgcgtccagaagctggccaccggcgactattggtttcggcaccatctggagacaaccgtggaaacaaaaagcgcgaccaaggatatgacgtacaaaagactctccctgaaccacatcaagaatattatcaaagttcgcattagccatcttggggacatcgtgtctgtcggagagtactga

SEQ ID NO: 4490 - RNA, 4275 nt, synthetic construct
  misc_feature 1..4275: note = Cas9 variant
  source 1..4275: mol_type = other RNA
atgaagagaatcctgggcctcgacctggggaccaacagcattggatgggcccttgtgaatgaggctgaaacagatgaggaagtctcctctatcattcggctgggcgttcgcgtgaaccccctcacggtggacgagacccagaatttcgaaaaagggaaaagcatcacaaccaacgccgagagaacactgaaacggtccatgcgcagaaatcttcaacggtacaagctgcgcagagatgcgctcgtcgagtttctgaaagaactgggattcattaccgacgagacaatcctctctgaacagggcaaccggaccacgtttgagacctgccgcctgagagctaaggccgccgaggaagagatcagccttgaagaactgtcccgggtgctcctgatgattaataagaaacgcgggtataagtctagcagaaaagttaagaaagaagaggatggagtgcttatcgacggcatggagattgctaagaagctgtacgaagaggatctcacacctggccagctgtgttcccagctgctcgaaagcgggaaaaaggtcctgccggacttctatcggtctgatcttcaagaggaactggaccgcatctggtccgtgcagaaacagtttcaccccgatgttttctgcgacgccgctaaggaggagattaaaggaaagaacagaagccagacctgggccatcctcgcgaattactttgtgtggaaagaagaggtcgtgggctggaacgatcgggaagccaagaatgagacaattgaaaaggagtgtaaactggtggggcttaagagaaccacgaaaggatatgagctgaagaaagaaaactaccgctggcgggctcaagccctcacagagcagctgggcctggaagagatcgctgtcgttctccaggagatcaatgggcagattaacgcctcttccggatatctgggcgcgatcagcgacagatctaaggtgctttacttcaatcatcaaaccgtgggccagtaccagatggccgaactggacaagaaccctcacgcttccctccgcaacatggtcttttatcggcaagattacctggacgagttcgatagaatttgggaaaaacaggccgagtttcataaggaacttacagctgagctgaaaaaggagatccgcgacatgattatcttctatcagcggagactcaaaagccagaaggggctgatctccttttgcgagttcgagcgcctggaaattgtggttgagaaggatgggaaaaagcaaaccaaagtgatcggctgtaaggtcattccccggtctcaccctctcttccaggaatttaaagtgtggcagaccctgaatgacatcaaggttcttgggagagagaagaaacgcaacgccctgagcgcctccgagagccgggctctctaccccgaagagaaggaaattctggcgagagagctggccatcaaagaaaatatgaagaaagctgatgtgcttaagctcctgttcgagaaccctcaggagctggacctcaattttaaacaaatcgatggaaaccggacaggcttctctctgttttccgcctatagcaagatgattgaaaagtacgggtatgagccgcttgacttcaaaaagcccgccgatgaaatcattggacagctgcgcacgatctttaccgacctcggctggaatacaaacctgttcaccattgacctgacaaaagagggcaaggagcttgaaatgcagccttactttagactctggcatctgctgtactctttcgagggggataataccagcacgggaaacggcaaactcatcgaaaagattatgcagctgtgcggggtcgagaaggaatatgctgtggagcttgcctccctgtcttttcaagacgattacggaagcctctccgcgaaagctatcaagcggatcctgccctatctgaaagagggcaatctttacgacgtcgcctgtgaatatgccgggtacagacacagcaagtcttccctcacaaaagaggaaattgagaacaaggtgctgaagggcaaactggaagttctccctaagaatagcctgcgcaaccccgtggtcgagaaaatcctttctcagatggtgaatgttattaacaccatcattgatacctatggaaagccggacgagatccgggtggaactggctagagagctcaaaaagtccgccaaggaacgcgaggaactgacaaaagctatcgccaagagcaccagagagcacgaggaaattcggaaactgcttcaggatgagttcggcatgatgaacgtctcccgcaatgacatcattagatacaagctctacgaggaactgaaagataacgggtataagacactgtactctaatcagtatatccctaaagagaagatttttagcaaggaaatcgacatcgagcatattatcccccaatcccgcctcttcgatgactctctgagcaacaaaacgcttgaatacaaggcgattaatatcgagaaaggaaacaagaccgcctatgatttcgtgaaagaaaagtacggcgaggaggggctgcagcagtatattaatcggtgcgaatccctctttaacgacaagaaagctaagctgagaaaactgaagatggagcaaaaagacatccctgatggattcatcgaccgggatcttcgcaatacacagtacattgccaagaaggctctggccatgctcaacgaaatctgtagacgggtggttgcgaccacaggcagcattaccgaccagctgcgcgaggattggcagctcgtcgacgtgatgaaagaactgaatcttcccaagtacgaggccctggggtttgtggagacgtatgaagataaagacggcagaaagatcaaacggattaaggattggaccaagagaaacgaccaccgccatcacgctatggatgccctcacagtcgctttcaccaaagacgcctttatccaatacttcaataacaagaatgccgctcaggattctggaaaccggaaccacacaaatattatcggcatcaaaaccagatattttgacaaggggcgcgcgctgccccctattccgctggagcagttccggatcgaagccaaacagcatcttgagaagctgctcgtgtccattaaggctaaaaacaaggttgtgacggtcaatgtgaacagaaccaaaaagcgcaaaggagaaaatacaaagatccaacagacaccccggggccagctgcacctcgagaccgtttacgggagccataaacagtatgtgaccaagattgagaaggtcaacgcctcttttgacgccgctaaaatcgccacagtgtccaagagagcgtaccgcaatgctctgcttaaacggctggaaacgttcggaaacgatcctaagaaagcctttaccggcaagaatgccctcgagaagaaccccctgtatgctgacaaataccaaacaatcagagttcctgaaaaggtgcagaccgtcgagttcgagacaatttacaccatccggaaacccgtggatccggccctgaatgtggacaaggtcgttgatgtgaaagtgcgcgcgattcttgaaagacggctgaaggagtatgggggcgaccctaagaaggcttttgtcaacttctgggaaaatcccatctggctcaacaaggagaaaggaattagcatcaagcgcgtgtctatcagaggcattaataacgcccagagcatccacgttaaaaaggataagaacgggaatcctatttgggacgaaaacggaaaacaaatccccgtggatttcgtcaatacgggcaacaatcatcacgtggccatttaccggaagcctgttctggacaaaaagggacaggtgacatttgatgaggacggaaacctcatgtatgagctggacgaagtcgtggttcccttctttgaggctgtgaccagagccaatcttggcctgccgatcattgataaagactaccgcaagtccgaagggtggcagttcctgtttagcatgaaacagaacgagtatttcgtctttcctaatgaaaagaccggcttcaaccccaaggaggtggatctcctgaatcccgacaactacgctatgatctctcctaatctttttcgggtgcaaacaatgtccaaagtcatgtatggaaacaatgttgtgagagattacaagttccgccaccatctggagaccacagtgaaagacatgaaggaactcaaagatatcgcctacaagcagtataagacgctgagctttggcaactccgtcgtgaaaattcggatcaatcacattgggcagatcgtttctgtgggagagtactga

SEQ ID NO: 4491 - RNA, 4275 nt, synthetic construct
  misc_feature 1..4275: note = Cas9 variant
  source 1..4275: mol_type = other RNA
atgaagagaatcctgggcctcgacctggggaccaacagcattggatgggcccttgtgaatgaggctgaaacagatgaggaagtctcctctatcattcggctgggcgttcgcgtgaaccccctcacggtggacgagacccagaatttcgaaaaagggaaaagcatcacaaccaacgccgagagaacactgaaacggtccatgcgcagaaatcttcaacggtacaagctgcgcagagatgcgctcgtcgagtttctgaaagaactgggattcattaccgacgagacaatcctctctgaacagggcaaccggaccacgtttgagacctgccgcctgagagctaaggccgccgaggaagagatcagccttgaagaactgtcccgggtgctcctgatgattaataagaaacgcgggtataagtctagcagaaaagttaagaaagaagaggatggagtgcttatcgacggcatggagattgctaagaagctgtacgaagaggatctcacacctggccagctgtgttcccagctgctcgaaagcgggaaaaaggtcctgccggacttctatcactctgatcttcaagaggaactggaccggatctggtccgtgcagaaacagtttcatcccgatgttttctgcgacgccgctaaggaggagattaaaggaaagaaccgcagccagacctgggccatcctcgcgaattactttgtgtggaaagaagaggtcgtgggctggaacgatagagaagccaagaatgagacaattgaaaaggagtgtaaactggtggggcttaagcggaccacgaaaggatatgagctgaagaaagaaaactacagatggcgcgctcaagccctcacagagcagctgggcctggaagagatcgctgtcgttctccaggagatcaatgggcagattaacgcctcttccggatatctgggcgcgatcagcgaccggtctaaggtgctttacttcaatcaccaaaccgtgggccagtaccagatggccgaactggacaagaaccctcatgcttccctcagaaacatggtcttttatcgccaagattacctggacgagttcgatcggatttgggaaaaacaggccgagtttcacaaggaacttacagctgagctgaaaaaggagatcagagacatgattatcttctatcagcgccggctcaaaagccagaaggggctgatctccttttgcgagttcgagagactggaaattgtggttgagaaggatgggaaaaagcaaaccaaagtgatcggctgtaaggtcattccccgctctcatcctctcttccaggaatttaaagtgtggcagaccctgaatgacatcaaggttcttgggcgggagaagaaaagaaacgccctgagcgcctccgagagccgcgctctctaccccgaagagaaggaaattctggcgcgggagctggccatcaaagaaaatatgaagaaagctgatgtgcttaagctcctgttcgagaaccctcaggagctggacctcaattttaaacaaatcgatggaaacagaacaggcttctctctgttttccgcctatagcaagatgattgaaaagtacgggtatgagccgcttgacttcaaaaagcccgccgatgaaatcattggacagctgcggacgatctttaccgacctcggctggaatacaaacctgttcaccattgacctgacaaaagagggcaaggagcttgaaatgcagccttactttcgcctctggcatctgctgtactctttcgagggggataataccagcacgggaaacggcaaactcatcgaaaagattatgcagctgtgcggggtcgagaaggaatatgctgtggagcttgcctccctgtcttttcaagacgattacggaagcctctccgcgaaagctatcaagagaatcctgccctatctgaaagagggcaatctttacgacgtcgcctgtgaatatgccgggtaccggcacagcaagtcttccctcacaaaagaggaaattgagaacaaggtgctgaagggcaaactggaagttctccctaagaatagcctgagaaaccccgtggtcgagaaaatcctttctcagatggtgaatgttattaacaccatcattgatacctatggaaagccggacgagatccgcgtggaactggctcgggagctcaaaaagtccgccaaggaaagagaggaactgacaaaagctatcgccaagagcacccgcgagcacgaggaaattagaaaactgcttcaggatgagttcggcatgatgaacgtctcccggaatgacatcattcgctacaagctctacgaggaactgaaagataacgggtataagacactgtactctaatcagtatatccctaaagagaagatttttagcaaggaaatcgacatcgagcacattatcccccaatccagactcttcgatgactctctgagcaacaaaacgcttgaatacaaggcgattaatatcgagaaaggaaacaagaccgcctatgatttcgtgaaagaaaagtacggcgaggaggggctgcagcagtatattaatcggtgcgaatccctctttaacgacaagaaagctaagctgcgcaaactgaagatggagcaaaaagacatccctgatggattcatcgacagagatcttcggaatacacagtacattgccaagaaggctctggccatgctcaacgaaatctgtcgcagagtggttgcgaccacaggcagcattaccgaccagctgcgggaggattggcagctcgtcgacgtgatgaaagaactgaatcttcccaagtacgaggccctggggtttgtggagacgtatgaagataaagacggccgcaagatcaaaagaattaaggattggaccaagcggaacgaccatagacaccacgctatggatgccctcacagtcgctttcaccaaagacgcctttatccaatacttcaataacaagaatgccgctcaggattctggaaaccgcaaccatacaaatattatcggcatcaaaacccggtattttgacaaggggagagcgctgccccctattccgctggagcagttccgcatcgaagccaaacagcaccttgagaagctgctcgtgtccattaaggctaaaaacaaggttgtgacggtcaatgtgaaccggaccaaaaagagaaaaggagaaaatacaaagatccaacagacaccccgcggccagctgcatctcgagaccgtttacgggagccacaaacagtatgtgaccaagattgagaaggtcaacgcctcttttgacgccgctaaaatcgccacagtgtccaagcgggcgtacagaaatgctctgcttaaacgcctggaaacgttcggaaacgatcctaagaaagcctttaccggcaagaatgccctcgagaagaaccccctgtatgctgacaaataccaaacaatccgggttcctgaaaaggtgcagaccgtcgagttcgagacaatttacaccatcagaaaacccgtggatccggccctgaatgtggacaaggtcgttgatgtgaaagtgcgggcgattcttgaacgcagactgaaggagtatgggggcgaccctaagaaggcttttgtcaacttctgggaaaatcccatctggctcaacaaggagaaaggaattagcatcaagcgggtgtctatccgcggcattaataacgcccagagcatccatgttaaaaaggataagaacgggaatcctatttgggacgaaaacggaaaacaaatccccgtggatttcgtcaatacgggcaacaatcaccacgtggccatttacagaaagcctgttctggacaaaaagggacaggtgacatttgatgaggacggaaacctcatgtatgagctggacgaagtcgtggttcccttctttgaggctgtgacccgggccaatcttggcctgccgatcattgataaagactacagaaagtccgaagggtggcagttcctgtttagcatgaaacagaacgagtatttcgtctttcctaatgaaaagaccggcttcaaccccaaggaggtggatctcctgaatcccgacaactacgctatgatctctcctaatctttttcgcgtgcaaacaatgtccaaagtcatgtatggaaacaatgttgtgcgggattacaagttcagacatcacctggagaccacagtgaaagacatgaaggaactcaaagatatcgcctacaagcagtataagacgctgagctttggcaactccgtcgtgaaaattcgcatcaatcatattgggcagatcgtttctgtgggagagtactga

SEQ ID NO: 4492 - RNA, 4278 nt, synthetic construct
  misc_feature 1..4278: note = Cas9 variant
  source 1..4278: mol_type = other RNA
atgagacggaacatcctgggcctcgacctggggaccacaagcattggattcgccaaggtgatcgaggatgaagactaccaaaattccgctgtcgagcttattggcgttcgcgtgaaccccctgacgaccgatgaacagacaaattttgagaaagggagacctgtgtctgtcaacgccgaccggaccctcaagcgcggaatgagacggaatctggatcgctatcagcttagacggcaccatctgatcgaagtgctcaaagcgaaccacattatcacagttgacaccaagctggctgaggatggcaaaaatacaacccatgccacgtacgccgtgcgcgctctggccgctaccgccgagatcccgctcgaagcgttcgccagagtcctgcttgctattaacaagaagcgggggtataaaagctcccgcaaggccaaaaatgaggacgaaggacagctgatcgatggcatggctgtggccaagagactctacgaggagaacctgacacccggccagctttcttatctgctcctgaaagaagggaagaagtacctgcctgacttttatcggagcgatctcaatgcggagctggacaaagtttggtccttccaaaagcagttttaccccgaaattcttaccgaggagttcaaaaagcacctggaaggaaaaggccagcgcgccacatctgctgccttttgggggcagtacggattcaacaccgctgagaataagggcagcagagaagagaaaaagctcaaggcctatcaatggcggtccgaagccgtggatcagcagctgacgaaagaggaagtcgcttacgtgatcacagagattaacaatgaccttaacaagagctctgggtatctgggagcgatctccgacagaagcaaagagctctttttcaacaagcagaccgtgggccaatacctgtatcagcagctgaaacaaaatcctcatacacgcctcaagggccaggtcttttaccggcaggattatctggacgagttcgaaaccatttgggaaacccaggccaagtttcaccccgagcttacagctgccctgaaagaagagatcagagatgttatcattttctaccaacgcaagctcaaatctcagaaggggctgatctccttctgcgagtttgaaagcaaagagattgaagtggagaagaacggacttaagatcaaaaagcggattggcctgagagtggcccctaaatcttccccgctgttccaggagtttaagatctggcaggtcctcaataacctggagttccgcaataaaagctccaaggaagtgtttgttcccgacatgacggctaagcaacaactcttcgatgaactgaacatcaaagggaatcttctggcctctgaggcgattaagatcctcggatacaaaaccaaggactgggaagctaactatcacacactggagggcaatcggaccaacaaaagcctgtacgatgcctatcttaagattctcgagctggaagggtacgacgaggatctgctcaaactgtccggaagcgacgatatcgacgtgtctaagattgaaaagtccgccagcgagatcaaacagatggtccatgctgtgtttgaagttcttggcatcaattctacaattctggacttcgatgccgaggctgacggcaaggcctttgagcagcagaccgcgtatagactctggcatctgctgtacagcgccgaagatgacaacaaaaagtatcttcaggaggatatcttcatttacgggcacgacaatatcggactcaaaaagaagctgtgtgaacgctttggcttccggcctgagcacacgaaaattctggtgaacgtcgctttttccggggattacggatctctcagctccaaggccatgagaaaaatctatcccttcattaaggaactgacatacgacaaggcttgccgcgaggccggctatcggcacagcgcgtcttcccttagcaaagaggaaatcgccaccagacctctgcagaagcggctcgggctgctgaaaaagaatgagcttcgctctcccgtggtcgagaaaatcctcaaccagatggtgaacgttgtgaatgctctgattgatgacgaaaacaagagacggaaagccagaggcctgtccgatgacttccattttgatgagatccgcattgaactcgctcgggagctgaagaagaatgccaaagaaagagccgagatgaccacaaacatcaatgctgcgaagcaacttcacgaaaagattatcaaaatcctgcagacccagttcggagtcagcaacccgtcccgcaatgacattatcagatacaaactctatgaggagctgaagaacaatggctacaaagacctgtatacaaacacgtacatttctcctgatatcctttttagcaagcaaattgacatcgatcatatcattccccagatgtccctcttcgacgattcttttagcaataagaccgtggttttccggaaagacaaccaggataaggggaataaaacagcctacgactatatcctgggaaagtacggcgaactggctctcgaggaatatatttcccgcatcaccagcctgtttgagcttgggaaaaagaacaaggaagagggaattaataaagccaagttccagaaactgcaaaagagactcatcgatatcggcgacgggtttattgagaaagatctgcgggaatctcagtacatcgccaagaaggctaaaaacatgctgtatgccatttgtcgctccgtggtcgcgacaagcggcgagatcaccgctagacttcgggaagactgggatctggtgaacgtgatgcaggagattaatctccctaagttccgcgccctgggactcacggaaatggttgagaaaaaggacggcgggcagaaagagagaatcattgactggaccaagcggaacgatcaccgccatcacgccatggacgctctgacaatcgcctttaccagacactctcatatccaataccttaatcacctgaacgcgcggaaggatgaggcttccaaatggcatcccgtcgtgagcaagattgaagaaaaagagacagacctcgtgtatgatgacctgggaaatagaaagcgccggttcaaagcccccatgcctaactttagagaggtcgtgaaggaacacctggagaatgttcttatctctcacaaggccaaaaacaaggtggtcaccaaaaataagaacaaaattaagacggctaaaggcgaaaagatcaagacagagctgaccccgcgcgggcagctccataaagaaacaatttacggacggtacagatattacgagagcaaggaggaaaaagtgggccccaagttcgatgccgagaccatcgggatggttgtgaatcctcagtatcgcaaactgctcctggaacggcttaccacaaacggcaatgaccccaagaaggctttcggaggcaaaaacacgctgtccaagaatcctctctacatcgatgaggccaaacaggaactgctgcccgagaagattcttctgagatggctcaacgacgattatagcatccgcaaagacgtcaccccggagaacctgaaggacgtgaagacaattgaaaaagttctcgatgaggggatcaagaaaattctgcttaagcggctggtggactttggaaatgatcctaaaaaggcgttctctgacctggataagaaccccatctggctcaatgaagccaaaggcatcaccattaagagagtcacaatctccggggtgaaaaacgctgaggccctgcactacaagaaagaccattttggaaatgctattcttaacgaaaatggcaagctgatccctagctccttcgtgtctaccgggaacaatcaccatgtcgccatttatcgggatgccgagggcaacctccaagagcgcgttgtgagcctgtttgacgctgtgcagctcgtcaatgcgggagaagccgtgatcgatagagagtacaacaaaggcattgggtggcagttcctgtttacgatgaagcaaaatgaaatgttcgtttttcccaacgagaagacaggattcgaccctaaagagatcgatcttctgaataccgacaaccggaagctgatctcccccaatctctttcgcgtgcagaaaattgcttctaagaactacttcttcagacaccacctggaaaccaacgtcgaggaacggaaagagcttaaggatatcgtgtataagccgcagctgggcctcaatgccattaaagacgttgtgaaggtcagaatcaaccatctggggaaaattatcagcgtgggagaatactga

SEQ ID NO: 4493 - RNA, 4281 nt, synthetic construct
  misc_feature 1..4281: note = Cas9 variant
  source 1..4281: mol_type = other RNA
atgcccagaaagaacatcctgggcctcgacctggggaccacaagcattggattcgccaaaatcattgaggatgacgattaccagtgctcctctgtggaacttatcggcgtccgggttaatcctctgacgaccgacgagcaaacaaactttgaaaaggggaaaccggtgagcgtgaatgctgatcgcaccctcaagagaggaatgcggcgcaacctggacagatatcagcttcggcgcgattacctgattgagatcctcagaacacaccatatcattaccgccgacacaaaactggcggaagatggcaagaataccacgcacaccacatatgctctgcgggccctcgccgctaccgccgagatccccctggaggctttcgtccgcgtgcttctggccattaacaagaaaagagggtacaagtcctctcggaaagcgaagaatgaagacgagggacagctcatcgatggcatggccattgctcgcagactgtatgaagagagccttacacctggccagttttcctaccaactgctcaaagaggggaagaagtatctgcccgacttctaccggtctgatctgaacaccgaactcaataaagtttggaactttcagaagcagttctaccctgagatcctgacggacgaatttaaacgccatcttgagggaaagggccagagagccacagctgtggccttctgggggcaacacggatttagcatggcggaaaataaaggctcccgggaggagaagaaactgcatgcctataagtggagaagcgaagctgcccacaagcagctcaccaaagaggaagtcgctttcgtgattacagagatcaacaatgacctgaacaagtcttccgggtaccttggagccatcagcgatcgctctaaagaactgtttttcaataagcagaccgttggccagtatctccaccaacagctgaaagagaacccccatacccggctgaagggccaggtgttttacagacaagactatctcgatgagttcgaaacaatttgggagatgcaggccaagttctactccgctctgacgcttgaactgaaagaggaagtccgcgacgtggtgatcttttatcagcggaagctcaaaagccagatggggctgatttctctttgtgagttcgagtccaaggaaatcgagattgagaaaaacggagaaaaggcgaagaaaagaatcggcctgcgcgtcgcccctaagagctccccgctctttcaagagttcaaaatctggcaggttctgaataacctggaatttcggaataagaaaaccaaggaggtgttcgtgcccgaaatggctgccaagcagcagctctttgatgagctgaacattaaagggaatcttctggcctctgaagctatcaagattctcggatacaaaacaaaggactgggaggccaactaccacaccctggagggcaatagaacaaacaaaagcctgtatgatgcgtggcttaagatcctcgaactggaggggtacgacgaaaatctgctcaaactgtccggaagcgatgacattgatgtctctaagatcgagaagcctgctcttgaaatccgccaaatggtgctggccgttttcgaggtgctcggcatttccggcgccatcctggactttgacgctgaggccgatgggaaggctttcgaacagcagcccgcctatcagctgtggcatcttctctacagcgcggaggacgatggaaagaaatattctcaagaagacatttttacctacggccacgataacatcgggctgaagaaaaagctgtgcgagaagttcggatttcggcctgaacacacgaaaattctcgtcaatgtggttttcagcgacgattatggcaacctgtcctctaaggccatgagacgcatctaccccttcattaaagagcttacatacgacaaggcttgtgccgaggctgggtatcggcatagcgccgcgtccctgaccaaagaagagatcgccgctagaccgctccagaatcggctggatctgcttaagaagaacgaactccgcagccctgtggtcgagaaaatcctgaatcagatggtgaacgtcgtgaacaccctggttgacgatgagaatcagaacagaaaggcccggggcctctctgaagactttcacttcgatgagattagaatcgaactggctcgcgagcttaaaaagaatgccaaagaacgggccgagatgacaaccaacattaatacagctaagcaatcccatgagaagatcattagaatcctgcagacggaatttggagtgcccaaccctagccgcaatgacatcgtcagatacaaactctatgaggaactgaagaacaatggctacaaagacctgtataccaacacatacatttctcgggatatccttttctccaagcagattgacgtggatcacatcattccccaaatgagcctctttgacgattccttctctaataaaaccgttgtgtttcgcaaggacaaccaggataaagggaataagacagcgtatgactacatcctgggaaagtacggcgagcaggccctggaagagtatatcagcagaattacctccctcttcgagctggggaaaaagaacaaagaagagggaatcggcaaggctaaatttcagaaacttcaaaagcggctggtcgatattggggacggcttcatcgaacgcgatctcagagagtctcagtacattgccaaaaaggccaataacatgctgtatgctatctgccggagcgtggtgtccacgagcggagaaatcaccgcccgcctgagagaggactgggatcttgttaacgtcatgcaggagattaatctgcccaaatttcgggcgctcggcctgacagaaatggtggagaagaaagacggggctcagaaggaacgcatcaccgactggacaaagagaaacgatcatcggcaccacgccatggacgccctcgctattgccttcaccagacattctcacatccaatacctgaatcatcttaacgcgcgcaaagatgaggctaataagtggcaccctgtggtctccaaaattgaggaaaaggagacggtgctgatctatgacgatctcggaaaccggaaaagaaagtttaaggccccgatgcccaatttccgcgaagttgtgaaagagcacctggaaaacgtcctgattagccataaggccaaaaataaggtggttaccaaaaacaagaataagatcaaaacagtgcggggcgagaaggtcaaaacagagcttacccctagagggcagctgcacaaggaaaccatctacggacgctatcggtactacgagtctaaagaagagaagattggccccaaattcgacgctgaaatgatcgggatggtgacaaaccctcagtataagaagctcctgctcgagagactggccgctaatggcaacgatcccaaaaaggccttttggggcaaaaatgcgcttaacaagaacccgctgtacgttgacgaggcccgccaggaactcctgcctgagaaaattctgcttcggtggctgaatgatgactattccatcagaaaggatgtgacgcccgaaaacctcaaggacattaaaaccatcgagaagatcctggacaaaggagtcaagaaaattctcctgaagcggcttgctgatttcgggaatgaccctaagaaagcctttagcgatctggacaagaaccccatctggcaaaatgaagctaaacgcattgccatcaagagagtgacaatttctggaatcaaaaacgccgctcctctgcatcacaagaaggatcatctcggcaatgacatcctggatgagaaagggaagcagattcccagctccttcgtgagcaccggaaacaatcaccacgtcgcgatctaccgggacgccgagggcaaccttcaggaacgcgttgtgtctctgtttgatgctgtgcaactcgtcaatgggggcgagccggtgattgacaaagaatataacaagggaatcggctggcagttcctgtttacaatgaaacagaatgagatgttcgtttttcctgatgagaagaccgggttcaaccccagagaagtggacctcctgtccagcggaaatcggaaacttatttcccccaacctgtttagagtccagaagctggcctctaagaattacttcttccgccatcacctcgagacgagcgtggaagagaaaaaggaactgaaaaacatcgcctataagcctcaacttggcctgaacgctctctccaatattgttaaagtgcggatcaaccatatcggggagattgtctctgtgggagagtactga

SEQ ID NO: 4494 - RNA, 4281 nt, synthetic construct
  misc_feature 1..4281: note = Cas9 variant
  source 1..4281: mol_type = other RNA
atgaagaacatcctgggcctcgacctggggattaccagcatctccttcgcccacattgtggaggatgaaaataaagagaagtctgaaatcaaagagcttggagtcagaattgttagcctgacaacggacgaacagtccgattttgagaagggcaaatctatcaccacaaacgctaatcggaccctcaagcatggggcccgcctgaaccttgacagataccaacagcggcgcaagtatctgatcgatctcctgcagaaagcgaatctgattacaagctcctctatcctcgctgagaacggaaagaataccacacacagcacctggcagctgagagccaaagccgtgacggaacggattgagaaggaagagttcgctcgcgtgcttctggccatcaacaaaaagagaggctacaagtccagccggaaagctaagaccgaggacgaagggcaagccattgatggaatggcgatcgccaaacgcctctatgacgagaatctgacacccggccagctttctctgcagctcctgcagcaaaacaagaaactgctccctgatttttacagatccgacctgcagcgggagttcgatcttgtctggaattttcagaagcagttctatccggacattctgaccgatagcttttacaaagaactccaaggcaaggggaaggacgctacatctaaagccttctccaagcgctatcattttgacaccgctgaaaacaaaggaagcaaggagtctgtgagactgcaggcctaccagtggcgggcggaggccatctccaaacaacttagcaaggaagaggttgcttacgtgctgacggaaatcaataacaatctcaacaacgcctccggctatctgggggctatttctgatcgcagcaaggagctgtacttcaatagacagacagtcggacagtatctctacgcccagctgcaagaaaaccggcacaattcccttaaaaacaaggtgttttatagacaggactacctggatgagttcgagcgcatctgggaaacccaggccagctttcataaagagctcacagacgaactgaagaaacagattcgggatgttgtgatcttctatcaaagaaaacttaagtctcagaaaggcctgatttccttctgcgagtttgaaagcaaggagatcgagatcgaaaaagacgggaagaccattaccaaaacaatcggagctcgcgtcgtgcccaagtctagccctctcttccaggagtttaagatttggcagatcctgaataacgtgacgtgtaaacggaagggcattagaaagaagaaatcctctgctaagagcaccgaactggatctcttcaatgagccctcccaaacaatctttagcctggacatggagtgcaaacagcttctgttcgatgaactcaacctgaagggcgacctgaagtctgataaagtccttaagctcctggggtactcccctcaggagtgggaaatcaattacaaccagctggagggaaatcgcacccaaaaagccctctatgaagcgtacctgaagattgttgagatggaggcccacgacgtgaaagacatccttcagattaagagcgccaaggatgactggtctctggatgaaagccccctctccgcttccgagatcaaagaaaaggtgaaagacatttttcaggccctgggcatctgtacaaagattctgtatttcgatcctcttctcccggtcaaagagtttgaaaagcaagactcttaccagctgtggcatctgctctatagctacgagtccgatgactctaccagcgggaacgagacgctgtatcggatccttgaaaagaaatacgcgttcaagagagagcacgctcgcatcctggccaatgtggccctccaggatgactacggatccctgagcacaaaagctattcggaagatctatcccaacattaaagaaaatcagtactctaaggcctgcgagctggctggctataagcactccaaacttagcctcaccaccgaggaactggaggccagagaactgaagaacatcattcctctcctgaaaaagaacgcgcttcgcaatcccgttgtggagaaaatcctgaaccaaatgatcaatgtcgtgaacgccctcattgaaaagaactctgagcgggatgctgaggggaaaatcacaaagtactttcatttcgacgaaattagaatcgagctggcccgggaactgaagaaaaatgctcagaagcgctatgagatgacccagaatattaacaaagccaaacttgaacaccagaaaatctccgagatcctccaaaagaagtttggaattaaaaatcctacaaagagcgatatcattagataccggctgtatcaggagctggaacacaacggctacaaagagctctacacgaatgcgcccatcgccagagacatgctgttctctaagaacattgaaatcgagcatatcgttccgaaagctcgcgtgttcgacgatagcttttccaataagacccttacattccaccggattaacagcaataagggcgaatataccgcctttgactacatcacatctctgaactccgaggaggaactcaaccagtatctgaccagagtcgagaatgcttacaaaaccaagagcatttccctgacgaaatataagaaccttctgaaaaaggcctctgaaatcggggatggattcattaatcgcgacctcagagatacacagtacatcgccaagaaagctaaggagattctgtttcaagtgaccaaaaacgtcctcagcacatccggctctatcaccgaccggctgcgcgaagattgggggcttgtggacgttatgaaggagctgaatatgcctaaatatcagagcctcggactgacggaggtggaagagagaaaggaaggcaacaaggtcacagtgatcaaaaattggaccaagcggaacgatcatcgccaccatgcgatggacgccctgacagttgctttcaccaaaccctcctacattcagtaccttaatcacctgaacgccagaaaggatgagaataacaaaaattattctgtgatcctcgccattgaggaaaaggagaccatcaaagtccctacaaacaatgggaagaacaagcgggtgtttattgaacccatccccaacttccgccaagtggctaaaaagcacctggaggaaatctttattagccataaagccaagaataaagttgtcacgaagaacgtgaataagcctgcgggcaccgacaaacagcagatcacactcaccccgagaggacagctgcacaaggagacaatttacggcaaatatcaatactatgtgaacaaggaggaaaaagtcggggtgaagttcgatgagcggaccatcacgaaggtttccaatcccctttaccgcgaagctctgctcaaaagactgcaggccaacgacaatgaccctaagaaagcctttacaggaaagaacgctctgagcaaaaatcccatttatcttgatgagaccaagaccaagacactgcctgaaaaagtgaacctcacctacctggaggaggacttctctatccggaaggatatctcccccgacaattttaaagatctcaagagcattgaaaaagtcatcgaccagggcgtgaagcgcattctgatcaaaagacttcaggattacgacaacgatccgaagaaggccttcgttgacctggagaaaaatcctatttggctgaacaaggaaaaagggatcgcgattaagcgggtgacaatctctggagtctccaatgctcaacccctccatatcggcaaagatcacctggggaagacgacccttaacaaggagggcaatgaaattcctgtggactatgttagcacaggaaacaaccaccatgtggccatctacagagacaaagagggcaatctgcaggagcagattgtctctttctttgaagccgtggtgcgcacccagcaagggctccccatcattgataagacatataaacaggaggaaggatggcagttcctgtttaccatgaagcagaacgagatgttcgtctttcctaatgctacgaccggcttcaaccccgccgagatcgacctcctggatccgaaaaataagaaacttatctcccctaacctgtttcgggttcaaaagattgctacaaaggactacttctttagacaccatctggaaaccaatgtggagacagataacgtgctcaagaataccacatggaagcgcgaagggctgagcggacttaaagacatcgtcaaggtgcggattaaccacctgggcgatatcgtttccattggggagtattga

SEQ ID NO: 4495 - RNA, 4281 nt, synthetic construct
  misc_feature 1..4281: note = Cas9 variant
  source 1..4281: mol_type = other RNA
atgaagcacatcctgggcctcgacctggggaccaacagcattggatgggcccttatcaaacaggatttcgagaataagcaaggcgaaattctggggatgggatccagaatcattcccatgtctcaggacatcctcggcgattttgggaaaggaaacagcgtgtcccagacagctgagcggacgaagtaccgctctgtcagacggctgcgcgaaagattccttctgcggcgcgagagactccatcggatcctgaatgttctgggctttctccctgaacactatgccagccagattgacttcaccaaacgctttggcaagttcaaggaggagacagaaccgaaactggtgtactccaacgaggggtttatcttcaagaaatcttttgaagagatgcttagcgatttcaagacccatcaaccccagctgctcgaggacaataaaaagattccttatgattggacaatctactatctgagaaagaaagcgctttcccggaagattgaaaaagaggaactggcttggatcctcctgaactttaatcagaagcgcggatactatcagctgagaggcgaggaagaggaggaaaaccccaataaactcattgagttctacagcctgaagatcgtggacgtccttgccgatgaacctcaaaaagggaagtctgacatctggtactccctgattctcgagaacggatggatctatcggcgcagctctaagacacccctgtttgattggaaagaaaagaccagagacttcattgtgaccatcgatcttaatgacgacggctccgttaaaacggataaggaggggaacgagaaacggagcttcagagcccctggagaaaatgactggaccctggtgaagaagaaaacagagcaggaaattgattcttcccgcaagaccgtcggcacatacatctatgagaccctcctgaaaaacccgaagcagaaaatcaagggcaagctggtgcggacgattgaaagaaaattttacaagacagagctcaaacagatcctggagaagcaaaaagagttccaccccgaacttcgccaggacgatctgtatagcgactgcgttcgggaactctacaagaataacgaggctcatcagctgaccctttccaagaaagattttgtgcacctgttcatggaggacattatcttttatcaaagacctctcgggtctcaaaagagctccattagcaactgtacactggagttccgcaaatacaaggatgaaaatggaaccgaacacacccagtacctgaaagccatccccaagtctaacccttattaccaggagtttcggatctggcaatggatgtataatctcaacatttacaaaaaggaagacgatacaaatgtcacgaaggacttcctgaacaccaaagctgactttgagtcccttttcgagtttctgaataacagaaaggaagtggatcagaaagccctcctgaagcatttcaaactgaatgacaagacacaccgctggaactatgtggaggataagaaatacccctgcaatgaaaccaagacaatgatccttagccggctcgacaaagtcgagaacatttctgatgactttctgaccagagaaatggagcagaagatctggcatattatctatagcgttaatgataaagtggagtacgaaaaggcgctgaagtccttcgccggcaaaaacaatctcgaggacaactctttctttgaggctttcaagaaatttccgcctttcaagagcgaatacggggccttttccgaaaaagctattaagaagctgcttcccctgatgcgcatgggaaaattctggaactataataacatcagcgagcagtctaagtcccggatccagaaaattatcacgggcgagtacgatgaaaatattaaggacaaagtgagagagaaggccatccacctcacaaccgaaaccgattttcaggggctgcagctgtggcttgtccagtatattgtgtacggacggcacagcgaggcggccatgctcggcaaatggaactctgctgacgatctggaggagttcctgaaggaatttaagcaacattccctccgcaatcctatcgttgaacaggtgatcacagagaccctgagagtcgtgaaagacatttggcagaagtatggcaacggggccaaagacttctttcgggaaatccacattgagcttggaagagagatgaagctgcccgctgaggaacgcgaacggctcacaagacagatcagcgagaatgaaaacacgaatttccgcattaaagccctgctggccgagatgatggatgacaactccgttgagaatgtgagacccttttctcctatgcaacaggaaatccttaagatctacgaggaaggcgtcctcaacagcgatattgagatcgaagacgatattctgaagatctccaaaaccgctcagccgtctagctccgacctgaagcggtataaactctggctggagcaaaagtacaaaagcccctacacagggcagattatccctcttaataagctgttcacccccgagtatgaaatcgagcatattatccctcagtctcgctacttcgatgactcctttacaaacaagattatctgtgaaagcgcggtgaataaactcaaggataactatattggactggagttcatcaaaaagctgggcgggtctattgtcgagtgcggcaacggaaaatccgtggccatccttaagcacgacgcttacgaagattttatcaagaaacattatgccaataacagaagcaagcggaataaactcctgctggaggacattcccgaaaagatgatcgagcgccagatgaacgataccagatacatttctaaatatatcagcggcgttctctccaatattgtgcgggtcgaagacgggacggacgagggagtgaacagcaagaatatcgttccgggcaacgggaagatcaccacacaactgaaacaggattggggacttaatgacgtgtggaacgatctgattctccctcgcttcgagagaatgaatcacctgaccaactctacagactttaccgcctggaatgaaaaccaccagaagttcctgcccacggtccctgtggagttttccaaaggcttcagcaagaaacggatcgatcatcgccaccatgctcttgacgccctggtgattgcgtgtgctacaaaggatcacgttaatctcctgaacaaccagtccgccaaatctgacaccaagagatacgatctcaagaaaaagctgatgaaatttgaaaaggtcgcctacaatcacccccaaacaggggagcggatcgaaagagaggctcctaaacagttccttaagccctgggagacctttaccattgacgccaagaaccatctggaaacaatcatcgtgagcttcaaacagaatctccgcgtgattaacaaggctacgaattattacgagaaatatgtcgaaaaggagggcaccaaagtgaaggaacgggttgagcagaagggaacaaactgggccatcagaaaaccgatgcacaaggagaccgtgtccggcaaaattgatctgcctcgcatcaaggtccccaaagggaagattctgacagcgacccggaagtctcttgacacgagcttcaatctgaaaacaatcggatccattaccgacaccggcatccaaaagatcctcaaaaactacctgcagtataaggataataaccccgaactcgccttttctcctgaggggattgaagacatgaataaaaacatcgagaagttcaataacggaaaagctcatcagagcatttccaaggtgagagtttttgagctgggcagcaagttcccgcttgggcaatctggcaataaaaaggaaaaatacgtggaggccgctaagggaacaaacctgtttttcgccatctatcaggataaaaatggcaagcgctcctacgaaaccattcccctcaacgaggtcatcgaacggcagaagcaggggctgagcgtggttgacctgaaaggagtggatgacttttacctttctcctaacgatctggtctatgtgccctccgaggacgagctcgaaaatatcagcatgattgatttcaacaagatgtcttccgagagaatctacaaagtggtcagctttacaggcaatcaaattttctttgttcgccaggacatcgcgacgtccgtggtgaacaaggccgagttcagcaccctgaataaaatggaacgggctattgatgggacaatgatcaaggaaacctgcgtcaagctccagatcgacagactgggaaacatttctaaaatctga

SEQ ID NO: 4496 - RNA, 4281 nt, synthetic construct
  misc_feature 1..4281: note = Cas9 variant
  source 1..4281: mol_type = other RNA
atgtacaacatcggcctggacattgggaccggaagcgtgggctggtgcctcacagatgagaatgggtatctgcttaaggtcaacagaaaaggaaataacggcaatacgtaccggaactccgcctggggagttcgcctgttcgaatctgctgacaccgccgcggattgtagaatcaagcggagcacacgcagacggtataaacgcagacggacccgcattatcgagctcagaaagattatgtccgacatgatcatgcccatcgatcctaatttttacgctcggctggacgaagccttcctttggaacgaggataaatctgacaaggccaaggctccgtttctcctgttcaatgataacgggtatgacgatgtgaaatactatacagactaccccaccatttaccacctccgcaagcatctgctggaaacaaaagagaaggccgatcctagatttatctatctggcccttcaccatatgatgaaataccggggccacttcctgtttgagggccagagcttcgaagctattgacaatatcgaggacacctttattgaactcgagcatctggtgaacgtctatgtgaaggagaaggaagatacggacaataacgcggagaataacgccctttaccaagaaatgaaaaactatctggctgataataaggttaaaaacaaggacaaaaaggagtacatcaccgatacattcattaaagccgactatgataataagtactccaaggaactcgctgccgcggtgctggggtacgagtttaacgtcggaatcatcgtgaatgacaactctctgaccgatgaggacggcaaagccctcaaggctaaattcgccgatgctaagtatgaagagaaagaagagaagctgagcgacacacttggggaacgctactatattatcgagaccctgaagaaaatttactcctggaaggttctccacagcatcctgggagacaataaatatctttcttacgccatggtggataagtatgagaaacactccgaacagctgaaggccctcaagtacctgtttcataaatacacgagccaggacgagtattctgagttcttccaccaggaaaagaacaaagaaggcaagtacattgtcaattatgctaactacatcaaagggatcaagagactgtccaatgagacaaacaagaaatataataccaagcaacagctctaccagagcattatgaaaatcctgggagagcgggcggccgatgacgaagtgtataagaaaattcttgtggagatggaacaggagacatttctggagaagatcaacaatgtcgataactctgctattccctaccaactcaacctgatggaaatggacaaaatccttacccagcagggcgtttactataaggagctgagagataataaggaactcctgctgaaaatgctcacctccaagatcccttactatgtgggccccctgaacaataacagcaatgggaaccgcaatttcgcctggatgacgaaaaaggacggaaaagagaacgaaaaggtgtacccttggaatgtcaaggatgtggttgacattgatgtgacagccgaggactttatcacccggatgacaaactattgcacctaccttccgaatgagaaagtcctgcccaaggaatccctcctgtatcagagatacatgctgcttgaggaactctctcaaattcgcatcgatggccggaaactgagcaaggaggacagaaaagctattatcaacgacctgttcattgggaagggacgcgtgaaggtttccgataaagactttaaggaatacctcaataaagtgaactatgtcaaggtgaatggcaaagggtacgatgtcacaggatatcagagcgacgatggcttcgcctgtgcgctgtcttcctacaacaagtttcggagaatccttggccatatcgacgagcagaacgagaagatgattgaagatatcatttattggatcaccgtgttcgaggacaaagatattgttaagcgcaaaatcaataagcaatacgctgaccggctgagcgccgaacagctcaaaaagatcctgaaactgaagtttaaggggtggggaagatattctagcaaacttctcaacggcattaagggggatatgggaacgacaatcattgagatgctggaagacgccgatgagcgcttcgcttactgcgactactgtcctaattttatgcagatcattaacaaagacgagaagatcaaacagatcattgatgacaatcggcccagatatgatggcaccaaggacctgctcgatgtgatccaagacatgcacacctcccctgccaaccggcgcgggatttggcagacaatgaaggctatcgaagagattatcgaatacatgggcgagaaaccccagcagatctatattgagttcgccagagaagatgacccgaaggcgaaaaataagcgggccgattctagaaaacgcgctatcgacaaggccctgaagaaacttaaggaggatgtcgtggacgaatacaacgagaaagtttataaggaactgaaacaatacgagaagcggctcgacgaggaaaaggtgtatctgtactttatgcagaatggaaaagatctgtacttccctgacaaggagcttaacctcgatgaactggagaaactggaaattgaccacatcattccctatagcctctccgatgacgatagcctggacaataaggctcttgtcctgaaaggcaacaatcagaacaaggggaataagatcgtgaaagaggccttccctcagctcttttctaactccggaaccgtgaactactggaagaatctgaaaaaggcgggcctgattagcgagaaaaagtataacaatcttcagaaaaacaatgttgatgacatcctcacaaaggggttcatcaacagacaactggtcgaaacgcgccagattgtgaagtctgtggccaatctgatcctcgattactataacgagcagattgacgtcatcgaagtgaaggcttccctgagcacctccgttagaaaaatgcttacatacgagaaaaaggataataacggattttggattgaaaataaagacaactgcatgttctataagaatcgggacatgaacgattaccatcacgcccatgacgcttacctggccaatatcatcggcctctatattcaaaagaactacccccgcctgcagaaagagctgaattattctcagtacagacggatctggcgcaagtattacgagaacaccaaaaacaataacggggtgaattggtttgccacacttggcaagttcagctccaacaatgaagaggctgattggtatggacaagacattatcgcgtacatgagaaaaatcttttgttaccgggatgtcctgatttctaagaaggtggaagagaacaccggcgccttctatagcgagacgaaatacccccgcgaagacaaggctgggtccaaactcgttcctctgaagcagggaaataacatgagaggcgccaataacctcaaagagctggatgcccggaagtatgggggatacaagggcggggaaaaggcttattttgtgcttgtcaaatactgcatcgagaaagccctgaagaaaaaggtgaaaaaggaatatcacatggagttcgttgagattccggtgtacatcgcgcgcggcattaagaataaagacatcaacctctacgattatgtctgtgacattctgaatgaagctaacaagaatagcgtggccgatgtggagatcctgagaaacaaagtccccaagtaccagatgattatcggagaaaacggcgaggaatattaccttgtttctgccaccgaggtgatcaattccaaacagtttgtgctcgggggagctaaccaacagtataatcggctgctgaactacattaagtatggcaagaatgacaaatggcagtacatccagacagagctcctggatgaacaacttattgggctgtacaacctcctgatcgccaagattaaagacgagtataagggattcagcaaagaagcggtcagaatccaggagaataactcttttgacaagctggatgtgaaggacaaaaaggagttcatcgctgaaatgattaaacttgttcagcctgattccgactacccctatctgggcaagtacgccaccgggctcagcaatcgcatgggccggaaaacaggagagaaggtgggcaagaaaatcaccctggtcgataagtctgtgacggggctctatgaaagacgcacaaccttcgagctggaagacgatagctccacaaaaagctgctga

SEQ ID NO: 4497 - RNA, 4281 nt, synthetic construct
  misc_feature 1..4281: note = Cas9 variant
  source 1..4281: mol_type = other RNA
atgaagaacatcctgggcctcgacctggggaccacaagcattggattcgcccacatcgtggaggatgaaaataaagagaagtccgaaattaaagagcttggcgtcagaatcgtttctctgacgaccgacgaacaaagcgattttgagaaggggaaatccattacaaccaacgctaatcggacactcaagcatggagcccgcctgaaccttgacagataccaacagcggcgcaagtatctgatcgatctcctgcagaaagcgaatctgatcaccccctctagcattctcgctgagaacggcaagaatacaacccactccacgtggcagctgagagccaaagccgtgaccgaacggatcgagaaggaagagttcgctcgcattcttctggccatcaacaaaaagagagggtacaagtctagccggaaagctaagacagaggacgaaggacaagccattgatggcatggcgatcgccaaacgcctctatgacgagaatctgacccctggccagctttccctgcagctcctgcagcaaaacaagaaactgctcccggatttttacagaagcgacctgcagaaggagttcgatcttgtgtggaattttcagaaacagttctatcccgacattctgacagatatcttttacaaggagctccaagggaagggaaaagacgctacctctaaggccttctccaaacggtatcattttgacacgacagaaaacaagggcagcaaagagtctgtccgcctgcaggcttaccagtggagagccgaggcgatctccaagcaacttagcaaggaagaggtggcctacgttctgaccgaaattaataacaatctcaacaacgcttctgggtatctgggagccatctccgatcggagcaaagagctgtacttcaatcgccagacagtgggccagtatctctacgctaagctgcaggaaaacagacacaattcccttaaaaacaaggtcttttatcggcaagactacctggatgagttcgagagaatttgggaaacccaggcctcttttcataaagagctcaccgacgaactgaagaagcagatccgcgatgtggttattttctatcagcggaaacctaagagccaaaaagggcttatctccttctgcgagtttgaaagcaaggagatcgagattgaaaaagacggaaagacaatcacgaagaatattggcgccagagtggtccccaaatcttcccctctgttccaggagtttaagatctggcagattctcaacaatgtgatctgtaaacgcaagggcatccggaaaaagaaaattagcgctaagaccacacagctggatctgctcaacgaatctagccaaaccatcttctccctggacatggagtgcaagcagcttctgtttgatgagctcaatctgaaaggggacctgaagtctgataaagtgcttaagctcctgggatacagcccccaggaatgggagattaactacaatcagctggaaggcaacagaacacaaaaagcgctctatgaggcctacctgaagatcgtcgaaatggaggctcacgacgttaaggacattcttcagatcaaatccgccaaggatgactggagcctggatgagtctcctctctccgccagcgaaattcgcgagaaagtgaaggctatcttccagaccctggggatctgtacgaaaattctgtattttgacccgcttctccccgtgaaggagttcgaggaacaagattcttaccagctgtggcatctgctctattcctacgagagcgacgattccacatctggaaatgagaccctgtatcggatccttgaaaagaaatacgcctttaagagagagcacgcgcgcattctggctaacgtcgccctccaggacgattacggcagcctgtccaccaaagccatccggaagatttatcctaatatcaaagaaaaccagtactctacagcttgcgagaaggccgggtataagcacagcaaactgtcccttaccacagaagaactcgaggctagagaactgaagaacatcattcccctgctcaaaaagaatgccctgcgcaaccctgtggttgagaaaatccttaatcaaatgattaacgtggtcaatgcgctgatcgaaaagaacagcgagcgggacgccgagggaaaaattacgaagtacttccattttgatgaaatcagaatcgagctcgctcgggaactgaagaaaaatgcccagaagcgctatgagatgacccagaacattaataaagctaagctggaacaccagaaaatctctgagattcttcaaaaggagttcggcatcaagaaccccacaaaatccgacattatcagataccggctctatcaggaactggagcacaatggctacaaggaactgtacaccaacgccccgatcgcgagagatatgctctttagcaaaaatattgagatcgaacatattgtgcctaaggcccgcgttttcgacgactctttctccaacaaaacactgacctttcaccggatcaatagcgataagggggagtatacggctttcgactacattacctctcttaacagcgaggaagaactgaaccagtatctcacaagagtggaaaatgcctacaagaccaaatccatcagccccacaaagtataaaaacctgctgaagaaggcttctgagattggagatgactttatcaatcgcgatcttagagacacccagtacatcgccaaaaaggccaaagaaattctgttccaagtcacgaagaacgtgctctccacaagcggctccatcaccgatcggctgcgcgaggactgggggctcgtcgatgtgatgaaagagctgaatatgcctaagtatcagtctcttggactgacagaagttgaggaaagaaaagacggcaacaaggtgaccgtcattaagaattggaccaaacggaacgatcatcgccaccatgctatggacgcgctcacagtggcctttacgaagcccagctacatccagtacctgaatcacctgaacgctagaaaagatgagaataacaagaattattccgttattcttgccatcgaggaaaaagagaccatcaaggtgcccacaaacaatgggaaaaacaagcgggtcttcattgaacctatcccgaactttcgccaagtggccaagaaacacctggaggaaattttcatctctcataaggctaaaaataaggtggttaccaaaaacacaaataagcccgccggcaccgacaagcagcagattacgctcacacctagaggacagctgcacaaagagaccatctacggcaagtatcaatactatatcaacaaagaggaaaagattggggtcaaatttgacgagcggaccatcgcgaaggtgagcaatcccgtgtaccgcgaagctctcctgaagagacttcaggccaacgataatgaccctaaaaaggccttcgctggcaaaaacgccctgtccaagaatcccatttatctcgatgagtctaaaacaaagaccctgccggaaaaggtcaacctgacataccttgaggaggactttagcatccggaaagatatttcccctgacaatttcaaggatctgaaaagcatcgaaaaggtgattgaccagggagttaaaagaatcctcatcaagcgcctgcaggcgtacgataacgaccccaaaaaggcttttgtggatctcgagaagaatcctatttggctgaacaaagaaaaggggatcgccattaaacgggtcacgatctctggagtgaataacgcccaaccccttcatattggcaaggaccacctggggaaaaccacactgaataaggagggcaaggaaatccctgttgactatgtgtccaccggaaacaaccaccatgtcgctatctacagagataaagagggcaatctccaggagcagattgtgagcttcttcgacgccgttgtgcgcgctcagcaagggatccccattatcgataagacatataaacaggccgaaggatggcagtttctgttcaccatgaagcagaacgagatgtttgtcttcccgaatgcgacgaccggctttaaccctgccgaaattgaccttctggatcccaaaaataagaagctcatctctcccaacctgttccgggtgcagaaaatcgctacaaaggactactttttcagacaccatctcgagaccaatgtggagacagataacattctgaaaaatgtcacctggaagcgcgaagggctttccggactgaaagacatcgttaaggtgcggattaaccacctgggcgatatcgtgagcattggggagtattga

SEQ ID NO: 4498 - RNA, 4281 nt, synthetic construct
  misc_feature 1..4281: note = Cas9 variant
  source 1..4281: mol_type = other RNA
atgaagaacatcctgggcctcgacctggggaccacaagcattggattcacgcacatcgtggaggatgaaaataaagagaagtccgaaattaaagagcttggcgtcagaatcgtttctctgaccacagacgaacagagcgattttgagaaggggaaatccatttctaccaacgccaatcggacactcaagcatggagctcgcctgaaccttgacagataccaacagcggcgcaagttcctgatcgatctcctgcagaaagccaatctgatcaccagctcctctattctcgcggagaacggcaagaatacaacccacagcacgtggcagctgagagctaaagccgtgaccgaacggatcgagaaggaagagtttgcccgcgtgcttctggctattaacaaaaagagagggtataagtccagccggaaagccaagacagaggacgaaggacaagctatcgatggcatggccattgcgaaacgcctctacgacgagaatctgacccccggccagctttctctgcagctcctgcagcaaaacaagaaactgctccctgatttctatagatccgacctgcagaaggaatttgatcttgtctggaatttccagaaacagttttacccggacatcctgacagatagcttctataaggagctccaagggaagggaaaagacgccacctctaaggctttttccaaacggtaccatttcgacacggccgaaaacaagggcagccgcgagtctgtgagactgcaggcttatcagtggcgggccgaggcgatttccaaacaacttagcaaggaagaggttgcctacgtgctgacagaaatcaataacaatctcaacaacgcttccgggtacctgggagccatctctgatcgcagcaaggagctgtattttaatagacagaccgtcggccagtacctctatgctcagctgcaagaaaacaaacacaattcccttaagaacaaagtgttctaccggcaggactatctggatgagtttgagagaatttgggaaacacaggccagcttccataaggagctcaccgaggaactgaaaaagcagatccgcgacgttgtgattttctaccaacggaaacttaaatctcagaaggggctgatctccttttgcgagttcgaaagcaaagagattgaaatcgagaaggatggaaaaaccatcacaaagtctattggcgccagagtcgtgcccaagagctcccctctctttcaggagttcaaaatctggcagattctgaataacgtgacgtgtaagcgcaaaggcatccggaagaaaaagtctagcgctaaatccaccgaactggacctctttaatgagcccagccaaacaattttctctctggatatggaatgcaagcagcttctgtttgaggaactcaacctgaagggggacctgaaatccgataaggtccttaaactcctgggatatagccctcaggagtgggaaatcaattacaaccagctggagggcaatagaacccaaaaggcgctctacgaggcctatctgaaaatcgttgaaatggaggctcacgacgtgaaggatattcttcagatcaagtctacaaaagacgactgggccctggaagagagccccctctccgcctccgaaattcgcgagcgggtgaaggctatcttccagaccctggggatttgtacgaaaatcctgtactttgatcctcttctcccggtcaaggagttcgaggaacaagactcttatcagctgtggcatctgctctacagctatgaatccgatgactctacaagcggaaacgagaccctgtaccgcattcttgagaaaaagtatgcctttaagagagaacacgcgaccatcctggctaatgtgacactccaggatgactacggctccctgagcaccaaagccatccggaagatttacccctatatcaaagagaaccagtactctacagcctgcgaaaaggctgggtataaacactccaagctgagccttacgaccgaggaactcgaggccagagagctgaagaatattatccctctgctcaaaaagaacgctctgcgcaaccccgttgtggagaaaattcttaatcaaatgatcaacgtcgtgaatgccctgatcgaaaagaactctgaacgggatgcggagggaaaaattacaaagtacttccattttgacgaaatcagaattgagctcgcccgggagctgaaaaagaatgctcaggaacgctatgagatgacccagaacatcaataaggccaaactggaacaccagaagatttccggcatccttcaaaaagagttcggcatcaagaaccctacaaaaagcgatattaccagataccggctctatcaggaactggctcacaatgggtacaacgacctgtacacgaatacctatatccccaaggagctcctgttctctaagaacattgatatcgagcatattgttagcaaagccagagtgtttgacgattccttcagcaataagacacttgcgtttcgcgagttcaacatcaaaaagggagaatctaccgcctttgactacatcacatccctgaataacgaagaggaactcaaccagtatctgaatcgggtcgagaacgcttacaaaaccaagaatattagcccggccaagtataaaaacctgcttaagaaggcttccgagatcggcgacgggttcattaatagagatctgcgcgacacgcagtacatcgccaagaaagccaaggaaattctctttcaagtgacaaagaacgtcctgtctaccagcggatccatcacagatagactccgggaggactggggcctggtggatgttatgaaagaacttaatatgcctaagtatcagtctctggggctcaccgaggtggaggaacgcaaagagggcaacaaggtcaccgtgattaaaaattggacaaagagaaacgaccaccggcatcacgctatggatgcgctgacggttgccttcaccaagcccagctacatccagtacctgaatcatcttaacgctcgcaaagacaagaataacaaaaattattccgtgatcctggccattgaagagaaggaaacaatcaaagtccctaccaacaacggaaagaataaaagagtgtttattgagcccatccccaacttccggcaagtggccaagaagcacctcgaggaaatttttatctctcacaaagctaagaataaagttgtcacaaagaacaccaataaacctgccggcacggataagcagcagatcacactgaccccgcgcgggcagctccataaggagaccgtgtacggaaaatatcaatactatgtgaacaaggaagagaaaattggcgtcaagttcgacaaagaaacaatcgcgaaggtgagcaatcccgtttacagagaggctctgcttaagcggctgcaggccaacgataatgaccctaaaaaggcctttgctgggaaaaacgccctctccaagaatcccatttatctggatgaggcgaaaaccaagacactgacggaaaaggtgaaccttacctacctggaggaagacttcagcatccgcaaagacatttctcctgataatttcaaggacctcaaatccatcgagaaggtcatcgatcagggagtgaaacggattctgatcaagagactccaggactacgataacgaccccaaaaaggcttttgttgatctggaaaagaatccgatttggcttaacaaagagaagggcatcgccattaaaagagtgacaatcagcggggtcaataacgcccaacctctgcacattggcaaggaccatctgggaaaaaccacactcaacaaggagggcaaggaaatccccgtggattatgtttctaccgggaataaccaccacgtggctatctaccgcgacaaagagggaaatctgcaggaacagattgtctccttctttgaggccgtggtgggcgctcagcaagggcttcctatcgtcgataagacgtataaacaggccgagggatggcagttcctgtttaccatgaagcagaacgaaatgttcgtttttcccaatgaggcgacaggcttcaaccctgccgaaattgacctcctggaccccaaaaataagaagcaaatcagcccgaacctctttcgggtgcagaaaattgctaccaaggattacttctttagacatcacctggagacaaatgtggacaccgataacgtccttaaaaatacaacctggaagcgcgaagggctgtctggcctgaaagacatcgtgaaggttcggatcaaccatctcggagatattgtgtccatcggcgagtattga

SEQ ID NO: 4499 - RNA, 4284 nt, synthetic construct
  misc_feature 1..4284: note = Cas9 variant
  source 1..4284: mol_type = other RNA
atgaagaaaatcctgggcctcgacctggggaccagctccattggatgggcccttgtgaacgaggctgaaacatctgaggaaaagagctccatcattaaactgggcgtcagagttaatcccctcacggtggatgagctgcagaacttcgaaaaggggaaatctatcaccacaaatgccgaccggaccgcgggacgcagcatgagacggaaccttcaacgctacaagctgagacgggagaatctcattgaggtgctgaaggaatataactttatcacagatgagatgatcctgtccgaaaatggcaaccgcaccacattcgagacctacagactccgggctaaagccgccgtcgaggaaatttctctggagcagtttgctcgcgtgcttctgatgatcaataagaaaagagggtataagagctcccggaaagccaagggagctgaaaacggcacgctcattgacggcatggaggttgccaagaaaatgtacgatgaagggatcacccctggagagctgtgccttcagctgctcacagcgggcaagcgctatttcccggacttttacagaagcgatctgcaggccgagttcgaccggatttggaattttcaaaaacagttctatcccgattctctgatcgacaaggtgaaagatgaagtccgcgggaagaacaaatcccagacctgggctattctcgccaagtactttgtgtggaaggaggttgaaaatagctggaacgaggaagaggctcagacaagacgggtggagaaagaatacagactggtcggaatcaagcgcggcgtgaaacgggaggaacttaagctggagaatttccaatggagagtgaaagccctctctgaacgcatgaaccctgaggagctggcgatcgtccttcaggaaattaacgagcagatctccaatagctctgggtatctgggagccatttccgaccggagcaaggaactctactttaacagacagaccgttggccaatatcagatggctgtgctggataataaccccaatatcggcctgcgcaacatggtgttctaccggcaggactatctcgacgagtttaatacgatttgggagaagcaagccgagttccacaaagagctgacagaagatcttaagaaagagatcagagacatcgtcattttctaccagcgccggctgaagtcccagaaagggctcatcaacatttgtgaatttgagagacgccagatcgaggtggaaattgatggaaagaagaaaatcaagaccatcggctctcgggttattcctagaagcagccccctgttccaagagtttaaaatctggcagacacttaatgacattgaagtgagcgtcctgggggtgaagaacaaacggaagaagcaggatgacaattctaccaccctcctggattccgctgagaacatcgacagcctgaaactcaatgtttctcgccctctggatgccgacgaaaagagccttctggccaaagagcttttcattagagataagctgacaaaatccgacgtgctgaagctcctctttaacaatccgcagaacctgaacctgaatttcaaaaacatcgacggaaatcggacgggctctgctctctatcaagcgtttagcaagattctggagatctccgggcatgaaagcatcaacttcaagaaatctgccgatgagattgtcgaacaggtgaagaccatcttttccgctcttggatggaatacagaggtcctgtgcttcgacagcgaaaaagagctcgataagcagccctactttaaactgtggcatctgctttactctttcgagggcgactccacccctacaggcgatgggaacctcattcagaagatcgccgacctgtgtggatttgaaaaggattatgccagcattctggctaatatcaccttccaagaggactacggctccctctctacgaaagccatcagaaagattctgccccaccttaaagatgggaaccagtatgacgtggcgtgcgaatacgctggatataagcacagcaaatcctctctgaagaaggaggagatcaaaaataaggttctcaaagataagctggaactgcttcctaaaaacagcctccgcaatcccgtggtcgagaagattctgaaccagatggtgaatgttatcaacgccattatcacaacctacggcaagccggacgaaatccggattgagctggccagagaactcaaaaagaatgctaaagagcgcgaggaactgaccaagtccatcgtggatacaaccaaaacacatgaggggattagagccatccttcagaacgacttcggcatgagccacgtctctcggaacgctattatccgctataagctgtacgaagaactcaaagacaatggatacaagacgctgtattccaacacctacatccctaaggaaaaactgtttagcaaggatttcgacattgagcacatcattccccaagccagactttttgatgactctttctccaataaaacactcgaggtgaagtccatcaacattgaaaaaggctctaagaccgcgtatgattttgtggaggaaaagtacggggagcagggactgcaggaatatctgaatcggtgtgaggttctcttccgcgacaaaaagacaaaactgagaaaacttaagatgcaagagagcgaaatccctgagggctttattgatcgggacctgcgcaacacccagtacatcgccaagaaggctctctccatgctgaatgaaatctgcagacgggtcgtggccacgaccggggctattacagatgagctgcgcgaggactggcagcttgtggatgtcatgaaagaactgaactgggagaagtataaagtgctcggactggttgaatacttcgaggacaatgatggcagactcatcgggcggattaaggactggaccaaaagaaacgaccatcgccaccatgccatggatgcgctgacagtggcctttaccaaggacgtcttcatccagtactttaataacaagaatgctagccttaaacccgatacgaacgaagccgctattcggaataagtatttccaaaacggcaaagccattccccctatgtctctggacgagtttagagccgaggctaagaaacacctcaacgatacactgatctccatcaagaccaagaataaagtggttacaatcaacctgaatcgcaccaagaaaaagaacggaattaataaaaagcagcagcagaccccgcggggccaacttcacctggaaacagtgtacgggagccataaacagtatgtcgtgaaggaggaaaaggttaacgcgtccttcgacgccgctaaaatcgccacggtgaataagcccgcctacagagatgctctcctgcgccggctccaggagaacggaaatgactctaaaaaggccttcaccggcaaaaacagcctggataagcagcctgtctggcttgacgcgaagcaaaatgaatgtgtgcccgagaaagtgaagacagtcatgctggagaccgtttatacagtgagaaaacctattgatgaaaagctcaacgtggacaaagtcgtggacgctcgcatccggaagctgctgcaggatagaatcaaggagtacgggaatgccaaatccgcctttgctaaccttgacgaaaatcccatttggctgaacaaggagaaaggaatcaccattaagcgggtttctgtgagcggcatctccaaagcccagtctctccacgaaaagaaggataaagacgggaatttcattctggataaggacagccgcagaatcccggtcgattttgtgaacacgggcaacaatcatcacgttgcgatttatcggaaacctgtgctcgacaagaaaggacaagctgtcttcgatgagaacggcgagctgaagtttgaacttgaggaagtggttgtgtccttctttgacgccgtcacacgcgtgaatctgagccagcccatcatcgataaagactacaagagatctgaggggtggaagttcctgttttccatgaaacagaacgagtacttcgtgtttcctaatgaaaagaccggattcgatcccaaagagattgacctcctgaaccctgaaaattatgcccttatcagccccaacctgttccgggtccagaagattgcttctaaagactacgtttttagacatcacctcgagaccgtggtggccgatcgcaaggaactgcaagagatcacatggaagcggatttccagcctctctatcctgaatagaatcattaaagtccgcgtgaaccacatcggccagattgttatgatcggggagtattga

SEQ ID NO: 4500 - RNA, 4284 nt, synthetic construct
  misc_feature 1..4284: note = Cas9 variant
  source 1..4284: mol_type = other RNA
atggccaagcccaaagactacaccatcggcctggatattgggacaaacagcgtgggatgggtcgttacggacgatcagaataacatcctcagaattaagggcaaaaaggctatcggggcccggctgttcgcggagggaaaagtggctgccgaacgcagatcctttcggaccacacgcagacggctttctcgcagacggtggcgcattaagctgctcgaggaactgttcgacaaggagatcgccaaagtggatcctagctttttcgctagacttcacgaatcctggatctctccgaaggacaaacggaagcgctatagcgccattgtctttccctcccctgaggaggataaaaagttccatgaatcttaccccaccatctatcacctgagagacaagctcatgaaagatgaccaaaagcatgatattcgggagatctacattgctgtgcaccagatgatcaaagcccgcggcaattttctgcatgacgaaagcgttgagacatatagatccgggatgagctctctgggaggccggtccgagagaaccattctcagcgtgcagacactggaggaacttaacgatctgttcgcggaaaatgagggcaccgaagaggccaagctcaacgtcgcttctgccgagcagatcaatgacatcctgacagggggacaccttaacgctgactcccaaaaagaaattggcaatctgctcctgcctagctcttttccctccttcgatgacaaggccaaagagaaacaggtgaagaaactgatcaagaacgttgcgaccaatattagcaaagcctggctcgggtacaaggctgatttttccacaatcctgaaccttgccaatgtggacaaagatcagaagaagattttcgcttttgccctgcagggaggcgacgaagaggataaagtccaagaactcgagtctctgcttgagcagagccagaccgacatcgtggatcgcctgatcgaaattcggcacgccatcgtgctctccgagattgtccctgttgggatgacactgagcgaagctatgatcgacaagtatgatcagcataaagaggacctgattaccctcaaggcggtgatcagaaacacgaaagacaagaagaaagccgctaagctgcaagccatctacgatctttacgtgaataaccgccacgccgacctggctaaagccatgaagctcacaggaattaaaaagcggtctgaactgcttgatccggaggagctgaagaaagcgatctccagcctcctggacgattctcccgaagctgtcgagattaagcagatgctggaagagaaaaccttcctccctctgcagagaagcaacaataacggcgtgatccccaatcaacttcatcaggttgagctggacgaaattatcaagaaacagtccaagtattaccctttcctcgccgagaaaaaccccgatgaatctgaggaagcccagaagaaggctccgacaaaactggacgccctgcttacctttcgcgtgccttattacgtcggccccatgattaccaaggaggagcaagaagctcaggatgggcacagcttcgcctggatggtgcggagagaccctcaggatcacgaggcgatcacaccctggaattttgaaaagaaggttgacaaaatggcctccgctacgcagttcatcaagcgcatgaccacaaaggatacctatctcctgggagaggacgtgctgcccgccagctctctcaaataccaactgtttacagtccttaacgaactgaataacctccgggtgaatggcaagaaactgacctccgacgagaaggagcaggtcattgaagggctgttcaaaaagcagaagacggtgaaagctgataagtttgttaaatattggcaggccaagcatatcggagcggacattaaagtgaagggccttagcgatccttctaagttcaactccacaatgagcacctacatcgactttaaaaagattttcggggatcaactcaatgacgtcaacagacagaatgattttgagaaaatcatcgaatactccaccattttcgaggaccgcaagatcctggaagataaactgcgggccgactttgcttggctctctgaggagcagattaagcagctgtgcagacttcggctgcaaggatggggccgcctcagcgataaactgctgacaagacttaccgacgccgatggccagaacgtgctcgaacggctgtggaatagcaacgacaacttcgttcagatcgtgtctgacccgaatattaaggctaagatcgagcaagaaaaccagaaactgctcagagatgggcagagcgacgatgccgtcgagtccatcctggacgatgcctatacaagcccccagaataagaaagctattcgccaagtgatgcgggtggttcacgacatcgtcaaggcgtgtgatggaaacgtgcctgccaaattcgctattgagtttgccagatctcaggaagacgatcccaagcgcacgaccgccagagtgaatcagatgcagaagatctacgaccaaatttccgatgaggtcgtgagccagggcgttaaagaacagctttctgggatgaagtccctgaaagaccggtattacctctatttcatgcagggaggccgcgacgcttacacaggggccaagctgaacatcgatagactgagcgactatgatatcgaccatattatgcctcaatcttttgtgaaagatgacagccttgataatcgggtcctcgtggcgcgcgctgttaacaatcagaagtccgacaaggtgcccgccctgctgttcggcaacaaagtcgtggccgatctcggaatcaccgttagagagatgtgggacaagtggcagaaactgggcatgattagcaagcggaaactttctaatctgctcacagatccggacgctctgaccgaataccgcgcccaagggtttatcagacggcagctggtggagacgtcccaggtcattaaacttaccgcgacaatcctgcagagcgagttccctgattccaagattatcgaagtgcccgctaaatacaactctatcgtgcgcaagcaatttgacctctataaaagcagagaggtcaatgactaccaccatgccattgatgcctatctgtccaccatcgttggaaactacctctatcaggtgtaccctaatctgcggagaatgttcgtgtatggcgaatttaagaaattctctagcaacgctgaggaatccgcctacgacgtcgtgcgccgggttaagtctatgaactttcttgatgacctgctcagagggacacacggagataatatttactgccgcagcaccggcgagatcgtgttcaaccggaatgacattatctccaagctgaaacaggcttatagctttaagcagatgctggtcacgcaagaggtgttcacgaaaaagtctgcccttttcgatcagaccgtttacccctcccctgaaagagacagcaaaaagcgctctgggctgatcccccggaaaaagggcatggatacagagatttatggaggctactccgggaacaaggacgcgtattttgtgctcgccgaagctgtcaaagagaagggacacaccctgcagatcgtgggcgttccgattagagccctcaataccctgaaaaacagcgctaattactctgaaaaacttctggagatcattaagcctcaggtgatgttcaacaaggatacagggaagcccatcaaaggaatcaaggacgtcaaaattctcatggataagatcccctgtcgccaacctgtgctggagggcgaatcctattacatgctggccagctccaaataccggtatagccttaagcagatttctctgagccagatgtccatgaagtacatcctcgactatattgacgatccgaattttaacaaacatgagatgatcaatattgaccagcaagatgaaaaggagtgcctgctctctgtgtacgacgagatcctggaaaagatggataagtatcttcccctgttcgacatcagatcctttcggaaaaagctgcacgatgggcgcgacgccttcattgctctccctgtcgcgtccgaggaaaagaaacccggcaaggttgatgtgatcagaaaagtgctgaagggacttcatgccaacgctgacattacgaatctggccgagctcggctttgggaccgccgctctgggagccctcgtctctacaggcgggatcaaaattagcgatgacgcggtgttcatctaccagtcccctaccggactgtttgaacggcgcgttaaggtgtctgaccttctgaaatga

SEQ ID NO: 4501 - RNA, 4287 nt, synthetic construct
  misc_feature 1..4287: note = Cas9 variant
  source 1..4287: mol_type = other RNA
atgaagaaaatcctgggcctcgacctggggaccacaagcattggatccgcctacgtgcttgaggctgaaaagtctgccgagcagacgaaaatcgtctatctgggcaccagaattatcctcagctccgcggatgctgaaaacttctctaaggggctgagctgctcccccacaaccgaccggacatttaaacgctctatgagacggcgccttcaaagatacaagcagcggcgcagctccctgattcagcagttcaagaaaatcggaatcattaccaatacagagcaaatcattagagaacctatcagcgagacccacgagctcctgcggattcgctctaaggccgtttccgaaagagtgagcctggaggaatttgcccggatcctcctgacgattaacaaacgcagaggctataagtctaatcggaaaacctccaagagcacagaggaggatgggaaacttgtggacgctatggccgtcaccaaggaactgatcaagctcaaaaagacaccgggacagtacatgttcgagcgctttaaaagaggcaagtatgctgaaatcgatttctacccctttgacctgattaacgagcttaaacagatctgggaagtgcagggccaaaagtatcctgatgttctgaccgaggacctcctgtcttccctgctcaagcagaaaacggggaaggccaaagagctgatttacagcaagtccgatcttaatcccgcggaagtgcctatcgactaccagaaaggaaagaagctgcggaaaacaattctcaacaagtatttcgcctacgagtctagaagcctggctgccaccaatatcatccccgtcgaacaggtgattacagctatcgttgccatttgtaaacaaatcaacaattccagcggctatcttggggcgattggagatcgctctcgggtgctgtacgccaacaatcagaccatcggccagtatctctacgagagaatcaaggctaaccctcatgaccgcattagaggggaagtcttttatagacaagattacctggacgagttcgaccgcatctgggagtgccagcagaattactatccggccattctgaccaacgatcggaaacagtttatcagaaatcgcattatcttctaccaacggcccctcaagtccaagaaaagcgaactggctttttgtgagttcgaatctagagaggtggaacacaacggaaagaaatatacagagggccttcatgtggcccctaagagctcccccgtcttccagcactttcgcctgtggcagcggctcggccagattgaggtttctcctctgagaaaatggaacaagcaaagcaatgaacttttcgagcagcagaacgacacggatcaggaacggatcctgaataccgaggccaagcaaaaactcttttcctacctgaacctgctcgaccatctgacagataatgagatccttaacattctggggtatagccccgacaagtggaaaatcaatttccgcgaaattatcggaaacagaaccaataactctatgatgaaggctttcttcaatatgaaagagatgacagatggcgaacagattaactgggagaagaatctcaccaaaatcacgaacgggcagtccctgatcagcccggaacagattgtggacctgatccggcaatttttcgagagagagggaattacaacctctcttctctactttgatcctaccacagacaatttccgcgaacagtcccactatagcctgtggcaccttctctactcctacgaggatgacaactctcccaccggcacaacgagcctgtgcaagacccttgcgaagcggtatgggatccctcatgaactgtgtcccctcctggcctccctgacatttgagccccagtacggatctcttagcaccaaagctatgagaaagattctccctttcatgcaagaaaacggctatgacaaagcctgcgagctggccggctaccgccactccgcttggacaaccaaggaggaaaatacggagagaaccctgaaaaacagcctcccgctgcttcggaaggggtctctgcgcaatcccgtggtcgaaaagatcctcaaccagatgacacatgtgatcaatacccacatttccgagtatggaaaccctgatgaaatcagaattgagatggcccgggacatgcaggcgaatagcaaacagcgcaaggctatgacaaccgccatcgccgaggctacgaaaagaaacacacaatttattgaagagatccagaaggaatttggcttcaatccctctaaaaacgatctgatcaagtacaagctgtggaaagagcttgcccctctcgggtccaagaccctgtatagcaatacatacattcccaaagaggaactgtttaccgctaagttcgagatcgaacacattatcccgcgggccctcttttacgacgattctttcagcaacaaaaccctggagcttaattccgttaacaagctgaagggaaataaaacagcgctcgactatatggatacgctgagccaggaacaggccaacgactacattatccgcgtggaggagctgaagaaaattggcgctatcacccaagccaagtataaaaagctgctcatcagagaaaaagatctgggggacgattttacaaaccgggacctgaccaatacacgctacattatcagacatgctgccgatatgctcctgcaggtcaccccttctattgtgcacacgaacggctccatcacagcgattcttcggagagactgggagctgctcgacatcctgaaggaactgaatcttcccacctatgagagcatcgatcgcaagatttccgaccctaaagaaaagctgaccgagtctgttgagcggaaagatggacaggccatcaagatgattaaagactggagcaagagagatgaccatcgccaccatgctatggatgccctcatcacagctctgaccacacggaagcacgtgcagtacctcaacggcaatagaggggccgaagagacggacaaagtccaaaagctgcagcagcttaaagccctgcgcaagcaactcattggatccgatggccacttcattccccctatgcatgacatccgggtgcaggctaaagaagcgctgtctagagtcatcatcagcaccaaggccaaggggaaagtgacaacccccaacacaaatattatctgttcccgcgataagaccacgggacggaaaatttatgttaagcagaccacactgaccccgagaggcgcccttcacaaagagatgcagtacgggtgcaaccattactatctggaaaagcaaatccctattggctctaagctcacagaggaggaaatccggctggtgagctcccccaaaatccgcagcatgctctctgagagactgcaggcttacaataacgaccccaagtccgcctttaccggacggaatagcatggataaaaagcctcttgaagacaaaaacaagaagctggtctatacagacaaaaaggtgaaacagaccattctcgctaatcgcttcgttaagagagatcgggtgaactctaaactggacctggataaggtcatcgacacgggcattaaaagaatccttgagcgccggctgaagcagtacgggggaaagtatgagacagccttttccgatctcgaaaataacccgatttggctgaacgaggaaaaaggcatcgcgatcaagagcgtgcggattcgcgggaaaaataacaccatcaccattcggcaaacaaatacctgtagaatcaagtacgtggctaacgacaataaccaccacctcgccgtttatgccctgcccgatggatctattgaggacgatatcgtctccttctttgacgctgtggaacgcagccggaaaggccttcctatcattgataagcataagaatcagtccctggggtggaaattcctgtttagcgtgaagcagaacgagtacttcctcctgccccagcaaggcgagaaaatcgacattgacacgggagaaatctctatgcagacaaccttcagccctaaggatctttcccccgagtacattatgaatcctgacaactatgccgaactggcgccccacatctttagagtccagtctattagcaaaacaccgcagggcaatcgcgatgtgagaatctacctcttcaagcaacagtatatctccgggtctcagaaggacagcctgcatctcaaaggaattacccaccggcaaatctcctctgctaaggatctggccggccttgttaaaattcgcgtgaaccatctggggagaatcgtcgccgtgggagagaagtga

SEQ ID NO: 4502 - RNA, 4287 nt, synthetic construct
  misc_feature 1..4287: note = Cas9 variant
  source 1..4287: mol_type = other RNA
atgaagaaaatcctgggcctcgacctggggaccgccagcattggatccgcttacgtgcttgaggccgaaaagtctgcggatcagacaaaaatcgtctatctgggcacgagaattatcctcagctccgctgacgccgagaacttctctaaggggctgagctgctcccccaccacagatcggacctttaaacgctctatgagacggcgccttcaaagatacaagcagcggcgcagctccctgattcagcagttcaagaaaatcggaatcattacaaataccgaacaaatcattagagagcctatcagcgaaacacacgagctcctgcggattcgctctaaggccgtttccgagagagtgagcctggaagagtttgctcggatcctcctgaccattaacaaacgcagaggctataagtctaatcggaaaacgtccaagagcaccgaagaggacgggaaacttgtggatgccatggctgtcacaaaggagctgatcaagctcaaaaagaccccgggacagtacatgttcgaacgctttaaaagaggcaagtatgccgagatcgacttctacccctttgatctgattaacgaacttaaacagatctgggaggtgcagggccaaaagtatcctgacgttctgacagaagatctcctgtcttccctgctcaagcagaaaaccgggaaggcgaaagagctgatttacagcaagtccgaccttaatcccgccgaggtgcctatcgattaccagaaaggaaagaagctgcggaaaacgattctcaacaagtatttcgcttacgaatctagaagcctggccgtcacaaatatcatccccgtggagcaggctattaccgccatcgttgcgatttgtaaacaaatcaacaattccagcggctatcttggggccattggagaccgctctcgggtgctgtacgctaacaatcagacaatcggccagtatctctacgaaagaatcaaggccaaccctcatgatcgcattagaggggaggtcttttatagacaagactacctggacgagttcgatcgcatctgggaatgccagcagaattactatccggctattctgaccaacgaccggaaacagtacatcagaaatcgcattatcttttatcaacggcccctcaagtccaagaaaagcgagctggccttctgtgaatttgagtctagagaagtggagcacaacggaaagaaatacaccgaaggccttcatgtggcccctaagagctcccccgtcttccagcacttccgcctgtggcagcggctcggccagattgaggtttctcctctgagaaaatgggataagcaaagcaacgagctttttgaacagcagaataacgctgaccgggaggggatcctgaatacagaagcgaagcagaaactcttctcctatctgaacctgctcgatcatctgacggacaatgagatccttaacattctgggatacagccccgataagtggaaaatcaattttcgcgagattatcggcaacagaaccaataacctcatgatgaaggccttcttttctatgaaagaaatgacagacggggagcaaattgattgggaaaagaatctgaccaaaatcacaaacggacagtccctgatcagcccggagcagattgtggaccttatccggcagttctttgaaagagagggcattaccacgtctctcctgtatttcgatcctgctacagacaattttcgcgagcaatcccactacagcctgtggcacctcctgtactcctatgaagacgataactctcccaccgggaccacaagcctttgcaagaccctggccaagcggtacggaatccctcatgagctctgtcccctgctggcctcccttacattcgaaagacagtatggctctctcagcacgaaagctatgcgcaagctgctgccctttatgcaggagaaaagatacgacgaagcctgcgagctcgcgggctatcggcactccgcttggattaccaaggaggaaaatgccaaacgcacactgaagaacaaacttcctctgctcagaaaggggagcctgcggaacccggtggtcgagaagatcctgaatcaaatgacccatgtgatcaacacacacattgccgaatacggaaatcccgatgagatccgcattgaaatggctagagacatgcaggccaactctaaacagcggaaggctatgaccgccgcgatcacggaggccaccaaacgcaatacacagttcattgaggaaatccaaaaggagtttggcttcaacccttccaagaatgatcttatcaaatataagctctggaaagaactggctcccctggggaacaagaccctctacagcaatatttacatccctaaagaggagctgttcacagccaagtttgaaattgagcacatcattcccagagctcttttctatgacgattctttttccaacaagaccctggaactcaatagcgttaacaaactgaagggaaataaaacggccctggactaccttgatacactcggccaggagaaggcgaacgactatatcctgcgggtggaggaactgaaaaagattggggccatcacccaggctaaatacaagaagctcctgatccgcgagaaagatcttggcgacgatttcacaaatagagacctgaccaacacccggtatattatcagacatgccgctgacatgctcctgcaggtcacaccgtctattgtgcacacgaacggaagcatcaccgccattctgcgccgggattggggccttctggacatcctcaaggaactgaatctccctacatacgagtccatcgatagaaaaattagcgaccccgaagagaagctgacccaatctgttgatcgcaaagacgggcaggccatcaagatgattaaggattggtccaaacgggacgatcatagacaccatgctatggacgcgcttatcacagccctgaccacgcgcaagcacgtgcagtatctcaacggaaatagcggcgctgaagagacagataaagcccagaagctggagcaactgaaagcccttcggaagcagctgattgggtccgacggacactttatccctcccatgcatgatatcagagtccaggctaaggaagccctctctcgcgtgattatcagcaccaaagtcaagggcaaagtgaccacacctaacaccaatattatctgttcccgggacaagacaacggggagaaaaatttacgttcggcaaaccacactgacaccccgcggcgcgctccacctggacaccaagtacggaatcaacagatattaccaggagcgggaagtgtctattggcagcaaacttacccaggaggaaatccgcctggtctcctctccgcatatccagagcattctcctggagagactgcgggctttcgataataaccctaagtccgcctttacggggagaaatagcgtggacaagaaaccccttgaggataagaacaaaaagctggtttataccgacaagaaagtgaagcaaacaatcctcgccaatcgcttcgtcaaacgggatcaggtgaactctaagctgaatctcgacaaagtgattgataccggaatcaagcggattctggaaggccgccttcagcagtacgggggaaaatatgagacagctttttccgacctggaaaacaatcccatctggctgaacgaggagaagggcatcgccattaagagcgttcggatcagagggaaaaacaatgcgattcctatccaccaaaccgatacatgcccgattgactacgtcgctaacgataataaccaccatctcgccgtgtatgtgctgcccgacggcaccatcgaagacgatatcgtcacgttctttgacgccgtggagcgctctcggcagggacttcctattgttgataagaataaaaaccagtccctgggctggaagttcctctttagcatcaaacagaatgaatacttcctgctcccccaacaggctgagaagattgacatcgatacaggggaaatttctacccagaccacattctcccctaaggacctgagccccgagtacatcatgaaccctgataattatgccgagcttgcttcccacatttttagagtgcagagcatctctaaaacgccccaaggaaaccgcgacgtcagaatctacctgttcaagcagcagtatattagcggctcccaaaaagattctctgcatctcaaggggatcacctaccggcagattagctccgccaaagacctggcggaacttgtgaagatccgcgttaatcacctgggaagaattgtgtctgtcggcgagaagtga

SEQ ID NO: 4503 - RNA, 4287 nt, synthetic construct
  misc_feature 1..4287: note = Cas9 variant
  source 1..4287: mol_type = other RNA
atgaccaagaaaatcctgggcctcgacctggggacaacgagcattggatgggcctacgtgatcgagtccgataaccccgacgaatctgagattaagcagatcggcgtcagagttaatcctcttaccacagatgaacaaaccaacttcgagaaagggaagccgtttagcattaataaagaacggacactgaagcgcggagctagacggaacctcgaccgctataaggatagacggaataacctgatcgaggtgcttaaaaaggccaatatcctgtcccaggactctattctcaccgaggaaggccagcacacaacccatcagacgtggcaactgcgcgcgaaagctgccgtggataagatcgagaaagaagaactggccagagtcctcctggctattaacaagaagcgggggtacaaaagctcccgcaaggccaaaaatgaggacgaaggacaggctatcgatggcatggccgtggcgaagagactttatgacgagcagattacctgcggccagctggtttaccaactcctgcgggaagggaaaaagtctatccccgatttctatcgcagcgaccttcaggccgagtttgataaagtgtggaacttccagaagcagttttaccctaagattctgacagacgagttctataaagagctcaagggaaaaggccaaagagctacctccgccctgttttacaagacatacaatttcaacaccgctgagaataaagggagccgggaagagaagaagatccaggcctataaatggcgctctgaagcgatctcccagcaactggagaaggaagaggtcgcctttgtgctcacggagattaacaataacctgaacaatagctctggataccttggcgctatctccgacagaagcaaagaactgtatttcaacaagcagacagttgggcagtacctctatcagcaactgcaggagaatcggcacgccagacttaaaaaccaggtgttttaccgccaggattatctggacgagttcgaggctatttggaaggaacaagccaagcatcacaccgagctcacagaggaactgaaagccgagatccgggatattatcatcttttaccagagaaagctgaaatctcagaagggactcatttccttctgtgagttcgaaagccgcgagatccagattgacggcaaaaagaagaccatcggcctgcgggtcgctcccaaatcctctcctctttttcaagagttcaagatttggcagaatctgaacaatgtgctcgtgagaaagaaggggagccgcaaacggaacgtcaagcaggaaatccagggatccctgtttgaagaggaaaaagagatcttcgtttttgatcttgagaccaaggaaaagctgttcgaggaactcaatctgaaaggcaacctgagcgcgaataaggtgattgagctcctggggcataaacccacagaatgggagatcaactactctgcccttgagggaaatagaacgaaccaagctctgtataatgcctacctcaagattctggacatcgaaggctatgatgaggacctgcttaaactctccgataaggacgatattaacgtggccgacctgaagacccctgctagcgaaatcaaaaacatggtccgcgacatttttcaggtgctggggatctctacagatatcctcgagttcgacgccgaactggatggaaaggactttgagcagcaagcgagctaccagctttggcatctgctctattcctacgagggcgatgactctcagagcggcaatgaaaaactgtatgagctgcttgaaaagaaattcgggtttaagaaggagcactcccaggttctcgctaacgtgaccctgagcgatgactacggaaatctgtcttccaaagccatgcggaagatttacccgttcatcaaagagaacaattatagcacagcctgcgaactcgctggctacagacactctaagcactccctgaccaaagaggaaattgagaaccgcccccttgatgacaagctggaactcctgaagaaaaatagcctgcggcaacctgtcgtggagaagatccttaaccagatggttaatgtggtcaactccctcctggagaaaaatagaaaggaaaaccccgattttcggttcgacgagattcgcatcgaactggccagagagctcaaaaagaatgctaaagaacgggccgagatgacgacaaacatcaattctgcgaagaccgagaacgaaaagattttcaaactgcttcaggccgagtttgggctgaagaaccctaccagaaatgatatcattcgctatcggctctacgaagaactgaaaaacaatggatataaggacctgtacacaaacaaatatatccccagagaaattcttttcagcaaacaggtggacatcgagcatatcattccgcaatcccgcctctttgatgactctttcagcaataagaccatcgtctacagagagacaaacctggataaaggcaatcagacggcttttgactacattgattccaagtatgggaacgaaaaagtggaggaatacatcctgcggattgaggccctccacgacgcttggaagaaaaataaggaggaaggcatcagcaaggccaaatatcagaagctgcttaaaaaggagaccgaaatcggagatggcttcattgagcgcgacctgagagaatctcagtacatcgcgaaaaaggccaaggagatgctctttaaaattacacggtccgttgtgagcacctctgggtccatcacagataagctgcgcgaggactggggactgattaacatcatgaaagaacttaatctgcctaagtatagaagcctcggcctgaccgagatgcaagaacggaaattcgggcagaaggtcgaggtgattaacgattggacgaagcgcaatgaccacagacatcacgctatggatgccctcaccgttgcttttacaaaacataaccacatccagtacctgaattatcttaacgcccggaagaacgaaaatcataaactgcacaacaatatcattgccatcgagaacctcgagaccgaaacaatgattgacaataacggatctaagcgcagagtgttcaaagctcccatgcctaattttcggcaagtcgcgaaggagcacctggaaaacgtgctgatcagccataaagccaagaataaggtggttaccaaaaacaagaataaaattgctggcaaggtcgccgcccaggagacgcttacacccagagggcagctgcacaaagaaaccgtgtacggcaagtaccagtattacgtgaacaaggaggagaaaatcggaacaaagttcgacgaagagaccatcaataaagtctccaacccccaatatcgcaagctcctgctcgaacggctgagcgctaatggcaacgatcctaaaaaggccttttctgggaagaatgcgctttccaaaaacccgatttacctgaacgagaccaagacagagacggtgcccgaagttgtgaaactcacctggctggaggaagactatagcatcagaaaggatattacacctgacaatttcaaagatgagaagtccatcgacaagattctggatgaaggagtcaaacgcatccttaagaaacggctgagaaagaacgacaatgatcccaaaaaggctttctctgacctcgataaaaaccctatctggctgaatgaggagaagggcattagcatcaagcgcgtgaccatttccggggttaacaatgccgaacccctccattacaaaaaggaccactttggaaacgacatcctggatgagaaaggcgacaagattccggtggatttcgtctctacagggaataaccaccatgtggccgtttatcgggacgaaaaaggcaatcttcaggagaacatcgtgagctttttcgaagctgtcattagagtgaatcagggactgcctatcatcgataaggcctacaaccagcacctgggctggcaatttctcttcaccatgaagcagaatgagatgtttgtgttccccaacgagaaatccgggtttaaccctcaggaaattgacctgcttgatccctctaataagaaaaagatcagccctaacctgttccgcgtccagaaaatgtccaaggttatttacggaaatagccccgtgcgggagtatgtgtttagacatcacctcgaaacgaacgtcgacgagaagaaagaactgaaggatatcacattcaaaaatattaagtctctcggctacttcgaggacatcgtgaaagttcggatcaaccatctgggggatattgtgtccgtcggagagtattga

SEQ ID NO: 4504 - RNA, 4293 nt, synthetic construct
  misc_feature 1..4293: note = Cas9 variant
  source 1..4293: mol_type = other RNA
atgaagcacatcctgggcctcgacctggggaccaacagcattggatgggccgtggtcaaagaggctcagaatgataacgaacaatccgagatcgttgacgtgggcgtgagagtcaatccccttacaacggatgaaaagaccaacttcgagaaagggaagcctatttctacaaatgccgaccggaccctgaaacgcagcgcgagacggaacctccagcgctacaagctgagacggaaggaacttatcgagctgctcaaagagcatcagctgatttccacagataccatcctgacagaaaatggaaagggcaccacgtttcagaccctcgagctgcgcgctaaatctgccaaggaaaagatcagccttgaggagctggccagagtgttcctcacaattaacaagaagcgggggtataaatcctctcgcaaggctaaaaatgaagacgagggacaactgatcgatggcatggaaattgccaagagactttacgaggaaaacctgaccacaggccagctcagcctgcagctgctcaaagaggggaagaaatccctgccggactattaccggagcgatcttcagtttgagctggacaaggtttggaatttccaaaagcagtttcactctgatatcctcaccgacgaattttatgctcagctgaaaggaaagggccagcgcgccacgtccgcgctttttctggccaaataccaaatttatacagctgagaacaaggggagcagagaagataaaaagctccaggcctaccagtggcgggtggacgctctgtctaaggagctgacccgcgaacaactcgccttcgtcatcacagagattaataacaatctgaacaactccagcggataccttggcgcgatctctgacagatccaaagagctgtattttaataacgaaaccgtgggggagtacctctggaagcagatcgccgctaatccccataccagcctgaaaaaccaggttttctatcggcaggattaccttgacgaatttgagcaaatttggaagacacagtccgccttctatcctgaaatcctgacggatgagctcaaaaaggagctgagagacgtggtcattttctaccagcgcaagctgaaatctcaaaagagcctcgtgtccttctgcgagttcgagaataaagaaatcgagattaagaaagaggatggaaccagcacaaagaaggtgatcggcctgaaagtcgctcccaagtcttcccctctttttcaggagttcaaaatctggcagaacctgaataacgttctcattcggaagaaaggcagcaagaccaaaaaggtggccaagaatcagcaggccgtgctgtttgaagaagagaaaacaatctctgaactggaccttgaggctaagcaagccctcttcaacgagctgaatctgaaagggaacctcaaggcggattattgtctggaaattcttggatacagccccaaagagtgggaaatgaattactccgtcctggagggcaacagaaccaataaggctctctatgaagcctacctgaagatcacggacctggaggggtatgatgccaaaaaccaccttaaggtgaaactcaacaaggacgaggttgaactggatgacctgaaagtgcctgcttctgagattaaggacatggtccaggccatctttaaggaagcgggaatcaatacagatattctccatttcaacgctgagctggacggcaaagattttgaaaatcaggccagctaccagctttggcatctgctctattcctacgagggggacgatagcaagtctggaaacgagctgctgtataaacttctcgaaaccaagttcggctttaaaaaggagtacgcccaaatcctggctaatgtgtccctgagcgacgattacggctctctctccaccaaggccatgcgcaaaattcacccgtatatcaaggaaaacaaattcagcacagcttgcgagctggccgggtaccggcactccaagcactctcttaccaaagaggaaaatgacaacagagttctgaaggatagcctcgaggtgctgaaaaagaactccctgcgccagcccgtcgtggaaaagattcttaatcagatgatcaatctcgtcaacgcgctgctgaaaaagtatcggacagagaatcctaactttaaattcgacgaaattagaatcgagctcgcccgcgagctgaagaaaaatgctgaggaacgggccaacatgacggctaacatcaataaggccaagaccgaacatgagaaaattatcaagattcttaaaaacgaatttggactgcccaatcctacaagaaacgatatcattcgctaccggctctatgaggagctgaaggcgaatggctacaaagacctgtataccaacatcaagatcccccaagaaaaacttttcacaaaagagattgatatcgaacacattatcccgaagtctagagtgttcgacgacagcttttccaataaaaccctgagcttccggaagacgaacctcgataaaggggagcgcaccgcctttgactacatggaatctaagttcggagctgataagctggaggagtacgttgccagagtggaagacctctataaaaataacattatctccaaggctaaataccagaagctgcttaaaaaggagagcgaaatcggcgatgggtttgtcgagcgggacctgagagagacacagtatattgccaagaaagccaaggaaatcctcctgcagattacccctaatgtgctgtctacatccggcggaatcaccgatcgccttcgggaggactgggatctgattaacgttatgaaagaactcaatctgcccaagtacagagctctcggcctgacgcaaatggaggaccgcaaatatgggcaacaggtggaagtcatcacagattggaccaagagaaacgaccaccggcatcacgcgatggatgcccttacagtggctttcaccaaacataatcacatccagtacctgaactatctcaacgcccgcaagaatgagaagcataaagagcacagcaacattatgggaatccagcagctggaaaccattaaggtgacagacaaaaatggcaacgagaagagagtttttaaagcccctatgcccaatttccggcaggtcacgaaggcttttctggaaaacatccttatttctcacaaggccaaaaataaggtggtgaccaaaaacaagaataaagtcgcggggagcaacaaggtgcaggaggttctgacaccccgcggacaactccataaggaaaccgtgtacggcaaataccagtattacgtccagaaggaggagaaaatcggggctaagttcgacctggaaacaattaaaaaggtggccaatcctctctatcaatccctgcttaagaaaagactggaggaaaacggcggagatccgaagaaagcctttaccggcaagaatagcctggctaaaaaccccatctacctcgacgatacgcagacagagcagctgcctgaaaaggttaaacttgtgtggctggaaaattctttctccatccggaaggacattacccccgagaactttaaggatgaaaaactcatcgacaagattctggatgagggggtcaaacgcatcctcaaggaaagactgcagagcttcggaaatgacgccaaaaaggcgttctccgatcttgacaagaaccctatttggctgaacaaagagaagggcatcaccatcaaacgggtgacaatttctggggttgctaatgccgagcccctgcacaccaagaaagatcatctcggaaaggaaatcctggacaaggagggcaaaccgattcctgtggactttatcagcacagggtccaaccaccacgtcgccgtgtatcgcgatgaaaagggcaatcttcaagagaaagtggtctctgttttcgaagctgtggtgagagccaaccagggactgcccattatcgacaagacgtacaatcagcatctcggctgggagtttctgttcaccatgaaacagaacgagatgtttgtcttccctaatgaaagcacagggtttaaccccaatgatatcgacctcctggatcctaagaacaagcggattatctcccccaatcttttcagagtgcaaaaattttctaagctgcagtatggaaacagcttcgttcgcgagtttgtgttccggcaccatctggaaaccacagtcgaggacagaaaagaactccagggcattacctacaagcagatgaaaaattccacgttctttaacgatatcattaaggtgcgcatcaatcacctgggggacattgttagcatcggagagtactga

SEQ ID NO: 4505 - RNA, 4293 nt, synthetic construct
  misc_feature 1..4293: note = Cas9 variant
  source 1..4293: mol_type = other RNA
atgaagcacatcctgggcctcgacctggggaccaacagcattggatgggccgtggtcaaagaggctcagaatgataacgaacaatccgagatcgttgacgtgggcgtgagagtcaatccccttacaacggatgaaaagaccaacttcgagaaagggaagcctatttctacaaatgccgaccggaccctgaaacgcagcgcgagacggaacctccagcgctacaagctgagacggaaggaacttatcgagctgctcaaagagcatcagctgatttccacagataccatcctgacagaaaatggaaagggcaccacgtttcagaccctcgagctgcgcgctaaatctgccaaggaaaagatcagccttgaggagctggccagagtgttcctcacaattaacaagaagcgggggtataaatcctctcgcaaggctaaaaatgaagacgagggacaactgatcgatggcatggaaattgccaagagactttacgaggaaaacctgaccacaggccagctcagcctgcagctgctcaaagaggggaagaaatccctgccggactattaccggagcgatcttcagtttgagctggacaaggtttggaatttccaaaagcagtttcactctcatatcctcaccgatgaattttatgctcagctgaaaggaaagggccagcgcgccacgtccgcgctttttctggccaaataccaaatttatacagctgagaacaaggggagcagagaagacaaaaagctccaggcctaccagtggcgggtggatgctctgtctaaggagctgacccgcgaacaactcgccttcgtcatcacagagattaataacaatctgaacaactccagcggataccttggcgcgatctctgacagatccaaagagctgtattttaataacgaaaccgtgggggagtacctctggaagcagatcgccgctaatccccacaccagcctgaaaaaccaggttttctatcggcaggactaccttgatgaatttgagcaaatttggaagacacagtccgccttctatcctgaaatcctgacggacgagctcaaaaaggagctgagagatgtggtcattttctaccagcgcaagctgaaatctcaaaagagcctcgtgtccttctgcgaatttgagaataaagaaatcgagattaagaaagaggacggaaccagcacaaagaaggtgatcggcctgaaagtcgctcccaagtcttcccctctttttcaggagttcaaaatctggcagaacctgaataacgttctcattcggaagaaaggcagcaagaccaaaaaggtggataagaatcagcaggccgtgctgtttgaagaagagaaaacaatcttcgaactggaccttgaggccaagcaagctctctttaacgagctgaatctgaaagggaacctcaaggcgtattactgtctggaaattcttggatactctcccaaagagtgggaaatgaattatagcgtcctggagggcaacagaaccaataaggccctctacgaggcttatctgaagatcacggatctggaagggtacgacgccaaaaaccatcttaaggtgaaactcaacaaggatgaggttgaactggacgatctgaaagtgcctgcctccgagattaaggacatggtccaggctatcttcaaggaagccggaatcaatacagacattctccactttaacgcggagctggatggcaaagacttcgaaaatcaggcttcttatcagctttggcatctgctctacagctatgagggggatgactccaagagcggaaacgagctgctgtacaaacttctcgaaaccaagtttggcttcaaaaaggagtacgcccaaatcctggccaatgtgtctctgtccgatgactatggcagcctctctaccaaggctatgcgcaaaattcacccgtacatcaaggaaaacaaattttccacagcctgcgagctggctgggtatcggcacagcaagcattcccttaccaaagaggaaaatgataacagagttctgaaggactctctcgaggtgctgaaaaagaatagcctgcgccagcccgtcgtggaaaagattcttaaccagatgatcaatctcgtcaacgccctgctgaaaaagtaccggacagagaatcctaacttcaaatttgatgaaattagaatcgagctcgcgcgcgagctgaagaaaaatgccgaggaacgggctaacatgacggtgaacatcaataaggccaagaccgaacacgagaaaattatcaagattcttaaaaacgaatttggactgcccaatcctacaagaaacgacatcattcgctatcggctctacgaggagctgaaggctaatggctataaagatctgtacaccaacgaatacatcgagaagcaagaccttttcacaaagaatatcgatattgaacacatcattcccaaatccagagtttttgacgactctttcagcaacaagaccctgtcctttcggaaaacgaatctcgataagggggagcgcaccgccttcgactatatcgaaagcaaatttggagcggataagctggaggagtacgtggccagagtcgaagacctctataagaacaatattatctctaaagctaagtaccagaaactgcttaagaaagagtccgaaatcggcgatgggttcgtggagcgggacctgagagagacacagtatattgccaagaaggctaaagaaatcctcctgcagattaccccgaacgttctgagcacatctggcggaatcaccgatcgccttcgggaggactgggatctgattaatgtgatgaaggaactcaacctgcctaaatacagagccctcggcctgacgcaaatggaggaccgcaagtatgggcagcaggtcgaagtgatcatcgattggacaaaaagaaatgaccatcggcaccatgccatggatgctcttaccgtggcgtttacaaagcacaaccatattcagtacctgaactacctcaatgcccgcaaaaacgagaagcacagagagcactccaatatcatgggcattcaacagctggaaaccatcaaggttaccgacaaaaacggaaatgagaagcgggtcttcaaagctcccatgcctaactttcgccaggtgacaaaggccttcctggaaaatgtgcttattagccataaagccaagaacaaggtcgtgacgaaaaataagaacaaagttgctgggtctaataaggtgcaggaggtcctgacccccagaggacaactccacaaagaaacagtgtatggcaagtaccagtattacgttcagaaggaggagaaaatcgggggcaagtttgacctggaaaccattaaaaaggtggccaaccccctctatcaaagcctgcttaaaaagcggctggaggaaaatggaggcgatcctaagaaagcgttcacagggaagaactccctggctaaaaatccgatctacctcgacgatgcccagaccgagcagctgcccgaaaaggtcaaacttgtgtggctggagaacagcttttctatccgcaaggacattacgcctgagaatttcaaagatgaaaagctcatcgacaagattctggatgagggagttaaaagaatcctcaaggaacggctgcagtccttcggcaacgacgccaaaaaggcttttagcgatcttgacaaaaaccccatttggctgaataaggagaaggggatcgccatcaaacgcgtggcgatttccggagtcgctaacgccgagcctctgcatacaaagaaagatcacctcggcaaggaaatcctggacaaagaggggaagtctattcccgtggacttcatcagcaccggcaataaccaccatgtggccgtctatagagatgaaaagggaaatcttcaagagaaagttgtgtccgtgtttgaagctgtcgtgcgggccaaccagggcctgccgattatcgacaagacctacaatcagcacctcgggtgggagttcctgtttacaatgaaacagaacgagatgttcgttttctctaatgaaagcaccggattcaaccctaatgatatcgacctcctggatcccaagaacaaaaagattatctcccctaatctttttagagtgcaaaagttctctaaactgcagtacggcaacagctttgtccgcgagttcgtgttccggcatcacctggaaacaacggttgaggacagaaaggaactccaggggattacctataaacagatgaaaaattccgctttcttcaacgatatcattaaagtgcgcatcaaccatctgggaggcattgtcagcgtgggggagtactga

SEQ ID NO: 4506 - RNA, 4293 nt, synthetic construct
  misc_feature 1..4293: note = Cas9 variant
  source 1..4293: mol_type = other RNA
atgaaggacatcctgggcctcgatctggggaccaacagcattggatgggccgtggtcaaagaggctcagaatgacaacgaaacatccgagatcgttgatcttggcgtgagagtgaatcccctgacgaccgacgaaaagacaaacttcgagaaagggaagcctatttctaccaatgccgatcggacactcaaacgcagcgcgagacggaacctgcaacgctacaaacttagacggaaggaactgatcgagctcctgaaagagcaccagctgatttccaccgacacaatcctcaccgaaaatggaaagggcacgtcttttcagaccctggagcttcgcgctaaaagcgccaaggagaaaatctccctggaggagctcgccagagtcttcctgacaattaacaagaagcgggggtataaatctagccgcaaggctaaaaatgaagatgagggacagcttatcgacggcatggaaattgccaagagactgtacgaggaaaacctcaccacaggccaactgtccctgcagctcctgaaagaggggaagaaaagccttccggattattaccggtctgacctgcagtttgagctcgataaggtgtggaatttccagaagcaatttcattcccacatcctgaccgacgagttctatgctcagcttaaaggaaagggccagcgcgccacgagcgcgctgtttctcgccaaataccagatttatacagctgaaaacaaggggtctagagaagataaaaagctgcaagcctaccagtggcgggttgacgctctgtccaaggagctcacccgcgaacagctggccttcgtgatcacagagattaataacaatcttaacaacagctctggatacctgggcgcgatctccgacagaagcaaagagctctattttaataacgaaaccgtcggggagtacctgtggaagcaaatcgccgctaatccccatacctcccttaaaaaccaggtgttctatcggcaggattacctggacgaatttgagcagatttggaatacacaagcccagttctatcctcagatcctcacggatgaactgaagaaagagctgagagacgttgtgatcttttaccagcgcaagctcaagtctcagaaaagcctggtctccttctgcgagttcgaaaacaaggagattgaaattaaaaaggaggatggaaccagcaccaaaaaggtgatcggccttaaggtggctcccaaatcttcccctctgtttcaggagttcaagatctggcagaatctcaacaatgtcctgattcggaaaaagggcagcaaaaccaagaaagccgccaagaaccagcaagctgttctgtttgaagaggaaaagacaatctctgagcttgacctcgaagcgaaacaggccctgttcaatgagctgaacctcaaggggaatctgaaagctgattattgtcttgagattctgggatacagccccaaggaatgggagatgaactactccgtgctcgaaggcaatagaaccaacaaagccctgtatgaggcctacctgaagatcacggaccttgaagggtatgatgctaagaaccacctcaaagtgaagctgaataaagacgaggtcgagctggatgacctcaaggtgcctgcctctgaaattaaagacatggttcaggcgatctttaaggaggctggaatcaacacagatattctgcatttcaatgccgaacttgacggcaaggattttgagaaccaggccagctaccaactgtggcacctcctgtattcctacgaaggggacgatagcaaatctggaaatgagctgctttataagctcctggagaccaaattcggctttaagaaagaatacgctcagatcctggccaacgtgtccctcagcgacgattacggctctctgtccaccaaggctatgcgcaagattcacccgtatatcaaagagaataagttcagcacagcctgcgaacttgcggggtaccggcattccaaacactctctgaccaaggaggagaacgacaatagagtcctcaaagatagcctggaagtgctgaagaaaaactcccttcgccagcccgttgtggagaagattctcaatcaaatgatcaacctggtcaatgccctgctcaagaaatatcggacagaaaaccctaattttaagttcgacgagattagaatcgaactggctcgcgagcttaaaaagaacgccgaggaacgggctaacatgacggccaatatcaacaaagcgaagaccgagcatgaaaagattatcaaaattctgaagaatgagtttggactccccaaccctacaagaaatgatatcattcgctaccggctgtatgaggaactgaaagccaacggctacaaggacctttataccaatatcaaaatcccccaggagaagctgttcacaaaggaaattgatatcgagcacattatcccgaaatctagagtgttcgacgacagcttttccaacaagaccctcagcttccggaaaacgaatctggataagggggaacgcaccgcttttgactacatggagtctaaattcggagccgataagctcgaagagtacgtcgctagagtggaggacctgtataagaacaatattatctccaaagccaagtaccagaaacttctgaagaaagaaagcgagatcggcgatgggtttgttgaacgggacctcagagagacacagtatattgccaagaaggctaaagagatcctgctgcaaattacccctaacgtgctttctacatccggcggaatcaccgatcgcctgcgggaagactgggatctcattaatgtcatgaaggagctgaacctccccaaatacagagcgctgggccttacggaaatggaggaccgcaagtatgggcaacaggtggaagttatcatcgattggacaaaaagaaatgaccaccggcatcacgccatggatgctctgaccgtggccttcacaaagcataaccacattcagtacctcaactatctgaatgcccgcaaaaacgagaagcataaggagcacagcaatatcatgggcattcaacagctggaaaccatcaaagtcaccgacaagaacggaaatgagaaaagagtgtttaaggctcctatgcccaacttccgccaggtgacaaaagcctttcttgaaaatattctgatctctcacaaggcgaagaacaaagttgtcacgaagaataaaaacaaggtggctgggagcaataaagtgcaggaggtcctcacaccccggggacaactgcataaggaaacagtgtacggcaagtaccagtattacgttcagaaagaggagaagattgggggcaaattcgacctcgaaaccatcaagaaagtggccaaccctctgtatcaatcccttctgaagaagagactggaggaaaatggaggcgatccgaaaaaggcctttacagggaaatacagcctcgctaagaaccccatctatctggacgatgcccagaccgagcagcttcctgaaaaagtcaagctggtgtggctcgaaaattctttctccattcggaaagacatcacgcccgagaactttaaggatgaaaagctgattgacaaaatcctcgatgagggagttaagcgcattctgaaagaaagacttcagagcttcggcaatgacgcgaagaaggctttctccgatctggacaagaaccctatctggctgaacaaggagaaagggatcacaattaagcgggtgaccatctctggagtcgccaatgccgagcccctccacaccaaaaaggatcatctgggcaaagaaattcttgacaaggaggggaagccgatccctgtggactttattagcacaggctccaaccaccacgttgctgtgtaccgcgatgaaaaaggaaatctgcaagagaaggtcgtgtctgtgttcgaagccgtcgttagagctaaccagggcctccccatcatcgacaaaacctataatcagcatctggggtgggagtttctcttcacaatgaagcagaacgagatgtttgtgttccctaatgaaagcacgggatttaaccccaatgatattgacctgcttgatcctaaaaacaagcggatcatttcccccaatctgttcagagtgcaaaccatctctgtcgtgaagtacggcaacgccattgttcgcgactttaaattccggcaccatctggagacaaccgtggaagataagaaagagctccaggggaagacataccagcagatcaaaagcctgtccccgcttaatgacattatcaaggtcagaatcaaccacctgggagatattgtgagcgttggcgaatattga

SEQ ID NO: 4507 - RNA, 4293 nt, synthetic construct
  misc_feature 1..4293: note = Cas9 variant
  source 1..4293: mol_type = other RNA
atgaagcacatcctgggcctcgacctggggaccaacagcattggatgggcctacgtgaaagaggctgaaaatgatacagagacgtccgaaatcgtcgaccttggcgttagagtgaaccccctgaccacagatgagaagaccaatttcgaaaaagggaagcctatttctacaaacgccgaccggaccctcaaacgcagcgcgagacggaatctgcagcgctataaacttagacggaaggagctgatcgagctcctgaaagaacatcaactgatttccgagaacacaatcctcaccgaaaatggaaagggcacgacctttcagacactggagcttcgcgctaaatctgccaaggagaaaatcagcctgggggaactcgccagagtgttcctgaccattaacaagaagcggggatacaaatcctctcgcaaggctaaaaatgaggatgaaggccagcttatcgacggcatggagattgccaagagactgtatgaagagaacctcacaaccgggcagctgagcctgcaactcctgaaagagggaaagaaatcccttccggattactatcggagcgacctgcagtttgaactcgataaggtctggaatttccagaagcagtttcactctgacatcctgacggatgagttctacgctcaacttaaaggcaaggggcagcgcgccacatccgcgctgtttctcgccaaatatcagatttacaccgctgaaaacaagggaagcagagaggacaaaaagctgcaggcctaccaatggcgggtggatgctctgtctaaggaactcacacgcgagcagctggccttcgttatcaccgagattaataacaatcttaacaactccagcggctatctgggggcgatctctgacagatccaaagaactctactttaataacgagaccgtgggagaatatctgtggaagcagatcgccgctaatccccatacaagccttaaaaaccaagtcttctaccggcaggactatctggatgagtttgaacagatttggaatacgcaggcccaattctaccctcagatcctcaccgacgagctgaagaaagagctgagagatgtggttattttctatcagcgcaagctcaagtcccagaaatctctggtgagcttctgcgaatttgagaacaaggaaatcgagattaaaaaggaggacggcacatccaccaaaaaggtcatcggccttaaggtggctcccaaaagctctcctctgtttcaagagttcaagatctggcagaatctcaacaatgtgctgattcggaaaaaggggtccaaaacaaagaaagccgccaagaaccagcaggctgtcctgtttgaagaagagaagaccatcagcgaacttgatctcgaggcgaaacaagccctgttcaatgagctgaacctcaagggaaatctgaaagctgactactgtcttgaaattctgggctactctcccaaggagtgggaaatgaactatagcgttctcgaggggaatagaacgaacaaagccctgtacgaagcctatctgaagatcacagatcttgagggatacgacgctaagaaccacctcaaagtgaagctgaataaagatgaggtggaactggacgatctcaaggtccctgcctccgagattaaagaaatggtgcaggcgatctttaaggaggctggcatcaacaccgacattctgcatttcaatgccgaacttgacgggaaggattttgagaaccaggcctcttatcagctgtggcacctcctgtacagctatgagggagacgattccaaaagcggcaatgaactgctttacaagctcctggagaccaaattcggctttaagaaagaatacgctcaaatcctggccaacgtttctctctccgacgattatgggaatctgagcacaaaggctatgcgcaagatttacccgtatatcaaagagaacaagttctctaccgcctgcgagcttgcgggataccggcactccaaacatagcctgacaaaggaagagaatgacaacagagtgctcaaagattccctggaagtcctgaagaaaaattctcttcgccagcccgtggttgagaagattctcaaccagatgatcaatctggtgaacgccctgctcaagaaatatcggacggaaaatcctaactttaagttcgacgagattagaatcgagctggctcgcgaacttaaaaagaacgccgaggaacgggctaatatgaccgccaacatcaataaagcgaagacagagcacgaaaagattatcaaaattctgaagaacgagtttggcctccccaatcctaccagaaacgatatcattcgctaccggctgtatgaggaactgaaagccaatgggtacaaggacctttacacaaacatcaaaatcccccaagagaagctgttcaccaaggaaattgatatcgagcatattatcccgaaaagcagagtcttcgacgattccttttctaataagacgctcagcttccggaaaaccaacctggacaagggagaacgcacagcttttgactatatggagtccaaattcggcgccgataagctcgaggaatacgtggctagagtcgaggacctgtataagaataacattatcagcaaagccaagtaccagaaacttctgaagaaagaatctgagatcggggatggctttgtggagcgggacctcagagaaacccagtatattgccaagaaggctaaagagatcctgctgcagattacacgcaatgttctttccaccagcggaggcatcacggatcggctgagagaagactgggatctcgtgaacgtcatgaaggagctgaatctccctaaataccgcgcgctggggcttacagaaatggaggacagaaagtatggacaacaggtggaggttattatcgattggaccaaacggaacgaccaccgccaccatgccatggatgctctgacagtggccttcaccaagcacaaccatatccagtacctcaattacctgaacgccagaaagaatgaaaagcaccgggagcattctaacattatgggcatccagcaactggaaaccattaaggtcacagacaaaaatgggaacgagaagcgcgtgtttaaagctcccatgcctaatttcagacaggtgacgaaggcctttcttgaaaacgttctgatctcccacaaagcgaagaataaggtcgtgaccaaaaacaagaataaagtggctggaagcaacaaggtccaggaggtgctcacaccccggggccagctgcacaaagagaccgtttatgggaagtaccaatattacgtgcagaaggaagagaaaattggcggaaagttcgatctcgaaacaatcaaaaaggtcgccaatcccctgtatcagtctcttctgaaaaagcgcctggaggaaaacggcggggaccctaagaaagcctttaccggaaagaatagcctcgctaaaaacccgatttacctggacgatgcccaaacggagcagcttcccgagaaggtgaaactggtttggctcgaaaattccttcagcatcagaaaggacatcacacctgagaactttaaagatgaaaagctgattgacaagatcctcgatgagggcgtgaaacggattctgaaggagcgccttcagtctttcgggaacgacgcgaaaaaggctttctccgatctggacaaaaatcccatctggctgaacaaggaaaagggaattaccatcaaaagagtcaccatcagcggcgtggccaatgccgagcctctccatacaaagaaagatcacctggggaaggaaattcttgacaaagagggcaagcccatcccggttgattttatttccaccggatctaaccatcacgtggctgtctatcgggacgaaaagggcaatctgcaggagaaagtggtgagcgtcttcgaggccgttgtgagagctaaccaagggctccctatcattgacaagacatacaatgaacacctgggatgggagtttctcttcacgatgaaacagaacgaaatgtttgtgttccccaatgagtccaccggctttaaccctaatgatatcgacctgcttgatcccaagaacaaacgcatcatttctcctaatctgttccgggtccagacaatcagcgtggttaagtacgggaacgccattgtgagagactttaagttccgccatcacctggaaaccacagtcgaggataaaaaggagctccagggaaaaacctatcaacagatcaagtccctgtctccccttaatgacattatcaaagtgcggattaaccatctgggcgatatcgttagcgtgggggaatactga

SEQ ID NO: 4508 - RNA, 4293 nt, synthetic construct
  misc_feature 1..4293: note = Cas9 variant
  source 1..4293: mol_type = other RNA
atggcccagaagtacatcctgggcctcgacctggggaccaacagcattggatgggctgtggtcaaagaggccgaaaatgataacgagcaatccgaaatcgttgacgtgggcgtgagagtcaatccccttacaacggatgagaagaccaacttcgaaaaagggaagcctatttctacaaatgcggaccggaccctgaaacgcggagctagacggaacctccagcgctataagctgagacggaaggagcttatcaaaattctgaaggagcaccagctcatcagcgatgacacaatcctggccgaaaatggcaaagggaccacataccagaccctgaagctccgcgccaaatcctctaaggagaagattagcctggaggaacttgctagagtgtttctgacgatcaacaaaaagcggggatataaatcctctcgcaagaccaaaaatgaggatgaaggccaactcattgacggcatggagatcgccaagagactgtacgaagagaaccttacaaccgggcagctgagcctccagctgctgaaagaaggaaagaagtccctcccggattattaccggagcgacctggagcttgagctggataaagtttggaatttccagaagcaatttcattctgacattctcacagatgagttctatacccagctgaaaggcaaggggcagcgcgctacgtccgccctttttctggaaaaataccagatctacacagtggaaaacaagggaaatagagaggaaaagaacctccaagcgtatcagtggcgggtcgacgccctgagcaaagagctgacccgcgaggaactcgctttcgtgattacagagatcaataacaacctgaataactcttccggctaccttggggccatcagcgacagatctaaggaactgtattttaataacgagaccgttggagaatacctctggaaacagattgctgccaatccccacacctccctgaagaaccaagtgttctatcggcaggattaccttgacgagtttgagagaatctggaatacacaggcgcagttctatcctcaaattctgacggaaagcctcaaaaaggagctgcgcgatgtcgtgatcttttaccagcggaagctgaaatcccagaagtctctcgtgagcttctgcgaatttgagaacaaagagattgaaatcaagaatgaggacggcaccacaaccaaaaaggtcatcggcctgaaggttgcccccaaatccagccctcttttccaggagttcaagatttggcaaaacctgaataacgtgctcatcagaaagaaggggtctaaaacagaaaaggtggctaaaaatcagcaggtcgtgctgtttgaagaggagaagaccatttccgaactggatcttgaggccaagcaggctctcttcaacgaactgaatctgaaaggaaacctcaaggccgactactgtctggagatccttggctatagctctaaagaatgggagatgaactacagcgttctggaggggaatcgcacgaacaaggccctctatgaggcttacctgaaaattacagatctggaaggatatgacgcgaagaattaccttaaggtgaaatccaacaaggatgaagtcgagctcgacgatctgaaagtgcccgcctctgaaatcaaggagatggttcaagctatctttaaagaggccggcattaataccgacatcctgcatttcgacgccgaactcgatgggaaggactttgagaaccagggaagctataagctgtggcaccttctgtactcctacgaaggcgatgacagcaaatctggcaatgagctcctgtataagctgcttgagaccaaattcgggctcaagaaagaatacgctcagattctggccaacatctccctgagcgatgactatggaaatctctctacaaaggcgatgcggaagattcatccttacatcaaagagaacaagttttccaccgcttgcgaactggccggctatagacacagcaaacactcccttacaaaggaggaaaatgagaaacgcgtgctgaaggatgggctcgaggtcctgaaaaagaactctctgcggcagccggtggtcgaaaagattcttaatcaaatgatcaacctcgtgaatgccctgctgaaaaagtacagaacggagaaccccaacttcaaatttgacgaaatccgcattgagctcgctcgggaactgaagaaaaatgccgaggagagagctaacatgaccgccaatatcaacaaggcgaagacagaacatgagaaaattgataagatccttaaaagcgagttcggactgcctaatcccacccgcaacgacattatccggtatagactctacgaagaactgaaggccaatggctacaaagatctgtatacaaaccggtacatctcctctgagaaactttttagcaaggagattgacatcgaacacattatccctaaatcccgcgttttcgatgacagcttttctaataagaccattgtgtatagaacggacaacctggataaaggggagcagaccgcttacgactatatcgaatccaagttcggcgccgagaaactcaaggagtacatgacacgggtcaaggatctgtatcagaaaaagatcattagcaaagctaagtaccaaaaactcctgaagaaggaatctgagatcggagacggcttcgtggaaagagatcttcgcgagacccagtacattgccaaaaaggcgaaagaaatcctgctccagattacacataatgttctgtccaccagcgggggaatcacggaccggctgagaaaggattggggccttgtgaacgtcatgaaagagctgaatctccccaagtatcgcgccctggggctcacaaaaatggaggacagaaagtacggacagcaagtggaagtgatcaccgattggacaaagcggaacgacctgcgccaccacgctatggatgcccttaccgttgcttttaccaaacataatcacattcagtatctgaactacctcaacgccagaaagaatgagaaacataaggaacacaacaatatcatggccattcagcagctggagacaatcaaagtcacggacgaaaacggcaatgagaagcggattttcaaggctccgatgcctaactttcgccaagtggcgaaaaccttcctggagaatgtgcttatctctcataaggccaaaaacaaggtcgtgaccaaaaataagaacaagattagcgggtccaataaagttcaggaagtgctgacccccagaggccagctccacaaggagacagtctatggaaaataccagtattacgtgcaaaaggaagagaaaatcggcgctaagtttgatagcgaaaccatcgagaaggttgccaaccctctgtaccagtctctcctgaaaaagcggcttgaggaaaatgggggagaccccaaaaaggccttcacgggcaaaaactccctggctaagaatcccatttatctggacgatacacagaccgagcaactccctgaaaaagtgaagctggtctggcttgagaacagcttttccatccgcaaggacattaccccggagaatttcaaagatgaaaagctgatcgacaaaattctcgatgagggggtgaagagaatcctgaaagaacggctccagtcttttggaaacgacgccaagaaggcgttcagcgatctggagaaaaaccccatctggcttaataaggaaaaaggcattgctatcaagcgcgttacaatttccggggtggccaacgccgagcctctgcacaccaaaaaggaccatctgggcaaggagatcctcgataaagaaggaaagcccattcctgtcgactttatctctacaggcaataaccaccatgtggctgtgtacagagatgagaaagggaatctgcaggaaaaggtccttagcgttttcgaggccgtggtgcgggcgaaccagggactgcccatcattgagaaaacgtataatcaacacctcggctgggaatttctgttctccatgaagcagaacgagatgttcgtctttccgaatgaatctaccgggttcaaccctaatgacatcgacctcctggatcccaagaacaaaagaattatcagccctaatctttttaaggtgcagaaactggctacaaagaactacatgttcacccaccatctggagacaaaatccattgacggagatatgctcaagaataaaaaggaactgagcggcatcctttataactttattcagacaccccaaaagctgtacgggatcatcaaagttcgcattaaccacctcggcgacatcgtgtctgtcggagagtattga

SEQ ID NO: 4509 - RNA, 4296 nt, synthetic construct
  misc_feature 1..4296: note = Cas9 variant
  source 1..4296: mol_type = other RNA
atgaagagaatcctgggcctcgacctggggagctcctctattggatgggcccttgtgaacgaggctgaaagcaaaaatgagcggtcctctatcgtcaagctgggcgttcgcgtgaaccccctcaccgtggatgaaagcattaatttcgagaaagggaagtccatcacaacgaacgccgacagaaccctgaaacggtctatgcgcagaaatcttcaccggtacaagctgcgcagagaagcgctcattgaggtcctgaaggagtgcaaatttatcacagaagataccatcctgagcgagaacggaaatcggacaaccttcgaaacatatcgcctcagagtgaaggctctgaccgaggagatttcccttgaagagtttgcccgggttctgatcatgattaacaaaaagcgcggctacaaaagctctagaaaggccgggggagctgaagaggacacgctcatcgatggcatggacattgcccggaagctgtatgatgctaatcttacccctggcgaactgtgtctccagctgctgtccgccgggaaaaaggtgctcccggacttctaccgcagcgatctgcaaaacgagcttgacagaatctgggagaaacagaaggaatattaccccggcattctgacagcggccctcaaagaggaactgcggggaaagaaaagagatgctgtctgggccatctgcgctaatgcctttgtgtggaaggagacctatacagaatggaacaatgaggagtctaagaacgaacagatcgagaaagaacataaacttgaggggatttactccaagcgcaagcgggacgaagcgaaaaaggagaatctgcagtggagagttagcggactcaaggagaaactgtctctggaacaactcgtgatcattctgcaggagatcaacacccagattaacaattccagcggctaccttgggacgatctccgatcgctctaaggaactgtatttcaacaaacagacagtcggacaatacctcatggacatcctggacaataaccctaatgccagccttcggaacattgtgttttatagacaggattacctggacgagttcaatgtgctctgggagaagcaggctgaatttcacaaagagctgaccggcgaactgaagaaggagatccgcgatattatcattttctatcagcggagactcaaatcccaaaagggcctgatcagcttttgtgagttcgagtctcgccagatcgaggtcaaaattgacgggaagcggaaaatcagaacagttggaaaccgcgtgattccccggtccagccctctttttcaggagttcaagatctggcaaattctgaataacatcgaagtgaccgccgtcggcaataagaacaaacagagaatgcagaatgggtctaacgaacccgatgacaccgagcagctcgaactgaatggacggcgctacctgtatcaagaggagaaggaacttctcgctaaagagctgttcgtgagagataagatgacaaaactggacgttctccggctgctttttgataaccctgaagaactggacctcaacttcaagacgattgatggcaataaaaccgggtacctgtttttccaggcctacagcaagatgatcgaaatgtccggacatgagccggtggactttaagaaacccatcgagaagattgtcgaacaggtgaaatctgttttcgtgctgcttaactggaatacagacatcctcagctttgattccaacaaggagctggacaaacagagctattacaagctgtggcacctcctgtattctttcgaaggcgataatacccctacaggcaacgggtgccttgtccaaaagattatggactcctacggactgggcaaagagtttgccaagatcctcgctaatattaccttccaggaggattatgggagcctgtctgcgaaagccatccataagatcctgccccaccttaaagaaggaaaccagtacgacgtggcttgtgagtatgccggctacagacactccaagagctccctcacgaaggaagagattgccaataaagtcctgaaggataaactggaagtgctccctcgcaactctctgcggaatcccgttgtggagaagatccttaaccagatggtcaatgtgattaacgctatcattgaggcctacgggagaccggacgaaatccgcgttgagctggcgagagaactcaaaaagaatgctaaggagcgggaaaaactgacaaagagcatcgccgagaccaccaaaacacatgaggcccacaagaaactgcttcaagaagagtttggcctcaagaacgtgggacgctccgatattctgagatataaactgtacaaggaactcgagtctcggggctataagaccctgtacagcaacacatatatccctcgcgaaaaacttttctccaaggagtttgacattgagcatatcattccccaggctagactgttcgatgacagcttctctaataaaacgctcgaagcccggaacgtcaatatcgagaaggggaaccgcaccgcttacgattttgtgaaagaaaagttcggagagtccggcacagacaatagcctggactgctatctgaacaatatcgaggtgctttttgtttctgggaagatttccaaaaccaagtacacaaaactgaagatgaccgaacaggatatccctggaggcttcattgagagagacctccggaacacgcagtacatcgccaaaaaggcgctgagcatgctcaatgaaatttctcgctgtgtcgtggccaccagcgggtccatcacagataagctgagagaggactggcaacttgtggatgtcatgaaagaactgaactgggagaagtataaagctctcggcctggtggagtactttgaagacaaggatggaaaacagattggccggatcaaggactggagcaagagaaatgatcaccgccaccatgccatggacgctctgaccgttgccttcacaaaagaggtgtttatccagtatttcaacaataagaacgcgtctcttaatcccaacaccaacgaatacgccattaaaaataagtattttcaaaacgggcgggctatcgcccccattcctctgaatgagttcagagctgaagccaaaaagcacctcgagaacacgctgatctccattaaggccaaaaataaggtcatcacaaacaatatcaacaaaaccaagaaacgcggaggcgtgaatacaaagaaacagcagaccccgcgggggcagctccatctggagaccatttacggatgctgtagacaatatcttacaaaggaagagaaggttaacgctagctttgatgtgtccaaaatcgcgacggtctctagctccgtgtaccgcgacgccctgctcaagcggctgcaggaacaccataatgatcccaaaaaggctttcgccggcagaaactctctggacaaaaagcctgtttggcttgacaaggagcagattcgcaaagtgcccgaaaaggtcaaaaccgtgacatttgagaccatctacacaattcggaaggagatcagccctgatctgagagtggacaaaatcattgattccggggtccggaagatgctcaccggccgcctgaaggaatatggaaatgacgccaaaaaggctttctctaacctcgatgagaaacccatctggctgaataaggaaaaaggcattccgatcaagagagttacgattagcgggatctccaacgcccagagccttcacgtgaagaaagacaaggatggaaaacctgtgctggacggcaatgggcggaacattcccgtcgatttcgtgaacacaggaaataaccaccatgttgcggtgtaccgcagacctgtcatcgacaagaatggccaaatggtgatcgatgagaacgggaatctgaaatatgagctcgaagaggttgtggtcacctttttcgacgctgtgacccgggttaacctgggccagcccattatcgacaaggattacaaagcctctgaaggatggcagtttcttttctccatgaagcagaatgagtattttgtgttccctaacaagaaaacaggctttaatcccaaggaaattgacctgctcgatgccgacaactacgggctgatcagcccgaatctcttcagagtccaaaaatttacccacaagaactatgtgttccgccatcacctggagacaacgattaaagatacctcttccatccttcggggaatcacatggattgactttagaagctctaagggcctggattccatcgtgaaggtccgcgttaatcacattgggcagatcgtgagcgtgggagagtactga

SEQ ID NO: 4510 - RNA, 4299 nt, synthetic construct
  misc_feature 1..4299: note = Cas9 variant
  source 1..4299: mol_type = other RNA
atgaagaaaatcctgggcctcgacctggggagcaactccattggatgggcccttgtgaatgaggctgaaaacagagatgaggcctctagcatcattaagctgggcgtccgggttaatcccctcaccgtggacgaaatgcagaacttcgagaaagggaagtccatcacaacgaatgcggatcgcaccctgaaaagatctatgcggcgcaaccttcaaagatacaagctgcggcgcgacgctctcattaagctgctgaaaaaggtgggatttatcgccgatggcacaatcctcagcgaacaggggaatagatccaccttcgagacatatcggctgcgcgccaaagctcctgacgaggaaatttctcttcaggagctggccagagtcctcctgatgatcaacaagaaacggggatacaagagctcccgcaagattaaagaaaaggaggctggcacccttatcgatggcatgaaagtggccaagaaactgtatgacgaggatctcacaccggggcagctgtgcctgcaactcctggaaagcggaaagaaatctcttcccgacttttactccagcgatctgcaggaggagttcgacagaatttggaattttcagaagcagttcaaccctaaggcgttttgtgataccgccaaagaggaaatcaagggcaaaaataagtctcaaacgtgggctattctcgccaaatatttcatctggaccgacgagatggttgtgtggaacgagaaggaatccaagacagagcgggtcgaaaaagagtgcaagctggtggggcttaaacgcaccgttaagaaagaagaacagagaaaggagaattaccggtggagagtgcaggctctgacagaacagctcgacctgggaaaggtcgccgtggtgctgcaagagatcaacggccagattagcacctcttccgggtatctcggagcgatcagcgatcgctccaaagtcctgtactttaatcggcagacggttggccaataccagatggccgaacttgagaagaaccccaacacatctctgagaaatatggtgttctatcgccaggactacctcgatgaatttgacaaaatttgggagaagcaggctgagttccacaaagaactgaccgtggagcttaagaaggaaatccgggatattatcatcttttatcaaagacgcctgaaaagccagaagggcctcattgggttctgtgagttcgagaaccgggaaatcatggtcgagaaaaatggaaagatgcaggccaaagtggttggctgcaaggtgattcctagatcccatcccctgtttcaggagttcaaaatctggcaaacactgaacaatgtcgaagtgtttgctggggaaaagaagtgtaaacgcaagcggaccgacgccttccctggactctttgatggcaccgaggacacactgatggttgaggggtggagatacctttatcaggaagagaaagaaattctggccaaggagctcagcgtgaaaaagtctctgaagaaagaatacatcctgaaacttctcttcgataacccgcaggacctggatatgaattttgagcagatcgagggaaacgacacgggcaatgtcctgttctccgcttatagcaaaatgattgaaaagtacggctacgagcccctcgactttgggaaatctaccgatgaaatcattgagcgcctgcaagtgatcttcacagaccttggatggaacaccgatctgctctttgtcgacctgaataaggaaggcaaggatctggagaaacagccttatttcaaactttggcacctcctgtacagctttgagggggacaacacacccaccggaaatggcaagctggtggaaaagctcatggagctgtgccatgttgggaaagaatgtgcgcttgagctggtgaacatttccttccagaatgattatggctctctcagcgccaaggctatcaagaaaattctgccttacctgaaggagggaaaccggtatgacgtcgcctgcggctacgccgggtatagacactccaaaagctctcttacgaaggaagagatcgaaaacaaagtgctcaaggataaactggacatcctgcccaaaaattccctccggaacccggttattgagaagatcctgaatcagatggtgaacgtcattaatgctatcattgatacatacggaaagcctgacgaaatccgcgtggagcttgccagagagctgaagaaaagcgcgaaggaacgggatgagctcaccaaagctatcgccaagtctaccagagaacatgaggaaattcgcaaggtgctgcaagaggagttcggcatgatcaacgtttcccggaatgacattatcagatacaaactgtatgaggaacttaaggacaacgggtacaaaacactctatagcaatcagtacattcccaaggaaaaagtcttttccaaggagatcgatatcgaacacattatccctcaggcccgcctgttcgacgattctctgagcaacaagaccctcgagtataaagctattaatatcgagaagggaaacaaaacagcctacgactttgtgaaggaaaaatatggcgagaaggggctgcaacagtaccttaatagatgtgaatccctgttcaagggccaccggacgaaactccgcaagctgaaaatgggacaggagaacattcccgagggctttatcgatagagacctgcggaatacccagtacatcgctaagaaagcccttgcgatgctgaacgaaatttgccgcagagtggtcgccacaaccgggtctatcacagatcggctccgcgaggactggcaactggtggatgttctcaaggaactgaaccttcccaagtatgagaccctgggactcgtggaagtctacgaggacaaagatggcagaaagattaaacggatcaaggactggacgaaacgcaatgatcatagacaccatgctatggacgccctgaccgtggctttcacaaaggacgtttttattcagtatttcaacaataaaaacgccgcgtggcaggccgattgtaaggagcacagcgacatcattgggatcaagacccggtactttgaaaatggcagagctctgcctccgatgccccttgtgcgcttccgggccgaggctaaatcccacctggaaacactcctggtcagcatcaaggccaaaaacaaggtggttaccaataacgtgaattgcacgaaaagaaagggaggggagaacaagaaactccagcaaacacctcgcggccagctgcatcttgaaaccatttatggatctcaccggcagtacgtcatgaaggaggagaaagtgaatgcctcctttgatagctctaagatcgctacagtgtgcaaacaggcgtatagaaacgccctgctcgaacgcctggctgccttcggcaatgaccccaagaaggcctttaccgggaaaaactccctggagaagaatcctgtctaccttgatcgggaacaaaccgctagagttcccgagcgcgtgcggacagtggaactggagacggtctacaccattagaaaaccggtggaccctaacctcagcgttgataaggtggtcgacgccaaagtgcggtctatcctggagcagcgcctcagagaatatgatggagaggcgaagcgggctttcgttaacctggacgaaaatcccatttggcttaacgaggagaagggcatcgccatcaaacgcgtgacaattagagggatcaataaggtccagagcctgcatggaaagaaggataaaaacggcaatctgattctcgacgaaaccgggaagaaaatccctgtggacttcgttaacacaggcaataaccaccatgtggccatttaccggaagcccgtcctggataagaccggacaagagatgcttgacaatgaaggcaaccctgtgtatgagctggatgaagtggtcgtttcctttttcgaggctgtgacgagagtgaatctcgggctgcccgtcatcgacaaaaactacaataagagcgagggatggcagtttatgttcacaatgaaacagaacgaatattttgtgttcccgaatgagaagaccggctttgatcctaaagaagttgacctcctgaaccccgagaattacgccgtgatctctcccaaccttttccgcgtccagaagattaccgaaaaggattatatgtttcggcaccacctggagacaaaagtggttgacgataagttcctgaaagagatcacctggaagcgcattctcacacctaacaaactggaagggatcgtgaaggtcagagtgaatcatattggacaaatcgtctccgtgggcgagtactga

SEQ ID NO: 4511 - RNA, 4299 nt, synthetic construct
  misc_feature 1..4299: note = Cas9 variant
  source 1..4299: mol_type = other RNA
atgaagaaaatcctgggcctcgacctggggagcaactccattggatgggcccttgtgaatgaggctgaaaactctgatgaggtcagctccatcattaagctgggcgttagagtgaatcccctcaccgtggacgaaatgcagaacttcgagaaagggaagtctatcacaacgaatgccgatcggaccctgaaacgcagcatgagacggaaccttcaacgctacaagctgagacgggacgcgctcattaagctgctgaaaaaggtcggatttatcacagatggcaccatcctctccgaacaggggaatcgcacaaccttcgagacatatagactgcgggctaaagcccctgacgaggaaatttctcttcaggagctggcccgcgtgctcctgatgatcaacaagaaaagaggatacaagagctcccggaagattaaagaaaaggaggctggcacccttatcgatggcatggaggttgccaaaaagctgtatgacgaagatctcacgccggggcagctgtgcctgcaactcctggagagcggaaagaagtctcttcccgacttttactccagcgatctgcaggaagagttcgaccgcatttggaattttcagaaacagttcaaccctaaggctttttgtgataccgccaaggaagagatcaaaggcaagaataaatctcaaacatgggcgattctcgccaagtatttcatctggaccgacgagatggtggtctggaacgaaaaagagtccaagacagaaagagtggagaaggaatgcaaactggttgggcttaagcggaccgtgaaaaaggaggagcagcgcaaagaaaattactgttggagagtccaggctctgacggagcagctcgacctggaaaaggtggccgtggtcctgcaagagatcaacggacagattagcacatcttccggctatctcggggctatcagcgatcggtccaaggttctgtactttaatagacagaccgtgggacaataccagatggccgaacttgagaaaaaccccaacacatctctgcgcaatatggtgttctatcggcaggactacctcgatgagtttgacaagatttgggaaaaacaggcggagttccacaaggaactgaccgtcgagcttaaaaaggagatcagagatattatcatcttttatcaacgccggcttaagagccagaaaggcctcattggcttctgcgagttcgagaacagagaaatcatggtggagaagaatgggaaaatgcaggccaaggttgtgggatgtaaagtcattcctcgctcccatcccctgtttcaggagttcaagatctggcaaaccctgaacaatgtggaagtttttgctggcgagaaaaagtgcaagcggaaaagaacagacgccttccctgggctctttgatggaacggaagacaccctgatggtggagggctggcgctacctttatcaggaagagaaggaaattctggctaaagagctcagcgtcaagaaatctctgaagaaggagtacatcctgaaacttctcttcgataacccgcaggacctggatatgaattttgaacagatcgaggggaacgacacaggaaatgtgctgttctccgcctatagcaagatgattgaaaaatacggctacgagcccctcgactttggcaagcctaccgataaaatcattgaacaactgcaggtcatcttcgccgaccttgggtggaacacagatctgctctttgtggacctgaataaggagggaaaggatctggagaaacagccctatttcaagctgtggcacctcctgtactcttttgaaggcgacaacacccctacggggaatggaaaactggttgagaagctcatggaactgtgtcatgtgggcaaagagtgcgctcttgagctggtcaacattagcttccagaatgattatgggtccctctctgcgaaggccatcaagaaaattctgccctacctgaaggaaggcaaccggtatgacgtggcttgtggatacgccggctatagacacagcaaatccagccttacaaaggaggaaatcgagaacaaagttctcaaggataaactggacatcctgccgaaaaattctctccgcaaccctgtggtcgaaaagattctgaatcaaatggtgaacgtgatcaatgccattatcgatacctacgggaaacccgacgagattcgggttgagcttgctagagaactgaagaaatccgccaaggagcgggaagaactcaccaaagcgatcgctaagagcacacgcgaacatgaggagatcagaaaggtcctgcaggaagagttcggaatgattaacgtgtctcggaatgatatcattagatacaaactgtatgaggaacttaaggacaacggctacaaaaccctctattccaatcagtacatccctaaggaaaaagtgtttagcaaggagattgacatcgagcacatcattccccaagcccgcctgttcgatgactccctgtctaacaagacactcgaatataaagccatcaatattgagaaggggaacaaaacggcttacgattttgtcaaggaaaaatatggagagaagggcctgcagcagtaccttaatcggtgcgagagcctgttcaaggggcagagaaccaaactccgcaagctgaaaatgggccaagaaaacatccccgagggatttattgacagagatctgcggaatacacagtacatcgccaagaaagctcttgccatgctgaacgaaatctgtcgcagagtggttgcgaccacaggctccattaccgaccggctccgcgaggattggcagctggtggacgtcctcaaggaactgaaccttcctaagtatgagacgctggggctcgtggaggtttacgaagataaagacggaagaaagatcaaacggattaaggattggaccaaacgcaatgaccacagacatcacgccatggatgctctgacagtggccttcaccaaggacgtctttatccagtatttcaacaataaaaacgctgcctggcaagcggactgcaaggagcattctgatattatcggcattaagacacggtactttgaaaatgggcgcagcctgccgcccatgcctcttgtgagattccgggccgaggctaaatcccacctggaaaccctcctggttagcatcaaggccaaaaacaaggtggtcacgaataacgtgaattgcacaaaaagaaagggaggcgagaacaagaaactccagcagtctccccgcgggcagctgcaccttgagaccatctatggctcccatcggcaatacgtgacaaaggaagagaaagtcaatgctagctttgactcttccaagattgccaccgtttgtaaacaggcctatagaaacgctctgctcgaacgcctggcggccttcggaaatgatcctaagaaggcttttaccggcaaaaacagcctggagaagaatcccgtgtaccttaaccgggaacagacagccagagtgccggagcgcgtccggacggtggagctggaaaccgtttacacaatcagaaaacctgtggaccccaacctctctgtcgataaggtggttgacgccaaagtgcgcagcattctggagcaacggctcagagaatatgatggggaggctaagcgggccttcgtcaatctggacgagaaccctatctggcttaatgaagagaagggaattgcgatcaaacgcgtgaccatcagaggcattaacaaggttcagtccctgcacgggaaaaaggataaaaatggaaacctgatcctcgacgaaacaggcaagaaaattcccgtggatttcgtcaataccgggaacaatcatcacgtggctatctaccggaagcctgtgctgaacaagacgggccaggagatgcttgacaatgaaggaaaccccgtctatgagctggacgaggttgtggtgagctttttcgaagccgtcacacgcgtgaatctcggcctgccggttattgataaaaactacaataagtctgaggggtggcagtttatgttcaccatgaaacaaaacgaatattttgtgttccctaatgagaagaccagatttgaccccaaagaagtcgatctcctgaaccccgagaactacgccgtgatctcccctaatcttttccgggttcagaagatcacagagaaggactatatgtttagacatcacctggaaaccaaagtggtcgatgacaagttcctgaaagagattacatggaagcgcatcctcacgccgaacaaactggaaggaattgtgaaggtccgggtgaatcacatcggccagattgttagcgtgggggagtactga

SEQ ID NO: 4512 - RNA, 4299 nt, synthetic construct
  misc_feature 1..4299: note = Cas9 variant
  source 1..4299: mol_type = other RNA
atgaagaacatcctgggcctcgacctggggaccacaagcattggattcgcccacatcgtggaggatgaaaataaagagaagtccgaaattaaagagcttggcgtcagaatcgtttctctgacgaccgacgaacagagcgattttgagaaggggaaatccattacaaccaacgctaatcggacactcaagcatggagcccgcctgaaccttgacagataccaacagcggcgcaagtatctgatcgatctcctgcacaaagcgaatctgatcaccccctctagcattctcgctgagaacggcaagaatacaacccattccacgtggcagctgagagccaaagccgtgaccgaacggatcgagaaggaagagttcgctcgcattcttctggccatcaacaaaaagagagggtacaagtctagccggaaagctaagacagaggacgaaggacaggccattgatggcatggcgatcgccaaacgcctctatgacgagaatctgacccctggccaactttccctgcagctcctgcagcagaacaagaaactgctcccggatttttacagaagcgacctgcaaaaggagttcgatcttgtgtggaattttcagaaacagttctatcccgacattctgacagatatcttttacaaggagctccaggggaagggaaaagacgctacctctaaggccttctccaaacggtatcactttgacacggctgaaaacaagggcagcaaagagtctgtccgcctgcaagcctaccagtggagagcggaggccgtgtccaagcagcttagcaaggaagaggttgcttacgtgctgacagaaatcaataacaatctcaacaacgcctctgggtatctgggagctatttccgatcggagcaaagagctgtacttcaatcgccaaaccgtcggccagtatctctacgcccagctgcaggaaaacagacataattcccttaagaacaaagtgttttatcggcaagactacctggatgagttcgagagaatctgggaaacacaggccctctttcacaaggagctgaccgacgaacttaaaaagcagattcgcgatgttgtgatcttctatcagcggaagcctaaatctcaaaaggggctgattagcttctgcgagtttgaatccaaagagatcgagatcgaaaaggacggaaaaaccattacaaagaatatcggcgctagagtcgtgcccaagagctctcctctcttccaggagtttaaaatttggcagatcctgaacaatgtgatttgtaagcgcaaaggcatccggaagaaaaagatctccgcgaaaacgacccagctggatctcctgaacgaaagctctcaaacaattttcagccttgacatggagtgcaagcagctgctctttgatgagctgaatctgaagggggaccttaaatccgataaggtcctcaaactgctgggatactctccccaggaatgggagatcaactacaatcagctcgaaggcaacagaacccaaaaggccctgtatgaggcttaccttaaaattgttgaaatggaggcccacgacgtgaaggacatcctgcagattaagagcacaaaagatgactggtccctcgatgagagccctctgtctgcctccgaaatccgcgagagcgtgaaggctattttccaggccctggggatctgtaccaaaatcctttattttgacccgctcctgcccgtcaaggatttcgaagaacaagactcttaccagctgtggcatctcctgtattcctacgaaagcgatgactccacgtctggaaatgagacactttatcggattctggagaaaaagtacgcgtttaagagagaacacgctcgcatcctcgccaacgtggccctgcaggatgactacggcagcctgtccaccaaagctattcggaagatctatcctaatattaaagagaaccagtactctaccgcctgcgaaatggctgggtataagcatagcaaactttccctcacaaccgaggaactggaggccagagagctgaagaacatcatccccctcctgaagaaaaatgcgcttcgcaaccctgttgtggaaaagattctgaatcaaatgatcaacgtcgtgaatgccctcattgagaaaaacagcgaacgggatgctgagggaaagatcacaaaatacttccactttgacgagattagaatcgaactggcccgggagctgaagaaaaatgctcagaagcgctatgaaatgacgcagaacatcaataaggccaaatctgagcaccagaagatttccgaaatccttcaaaaagagttcggcattaagaaccccaccaaaagcgatatcattagataccggctctataaggagctggaacataatggctacaaggagctgtacacaaacacctatatcgcgccggacgttctcttttctaaaaatatcgacattgaacacatcgtgcctaaggccagagtcttcgatgactccttcagcaacaaaacactggcttttaaggatttcaatattaaaaagggggagtctaccgcctttgactacatcacgagccttaagaacgaagagaaactgaaccagtatctcgctcgcgtggagaatgcctacaagaccaaaaacatttcccccgccaagtataaaaatctgctgaagaaggctagcgaaatcggagatggcttcattaaccgggaccttagagatacacagtacatcgcgaaaaaggccaaagagatcctgtttcaggtcaccaagaatgtgctctctacatccgggagcattaccgaccgcctgagagaagattggtccctcgttgacgtgatgaaagagctgaacatgcctaagtatcaatctcttggactgacggaagtcgaggagcggaaggatggcaataaagtgacagttatcaaggactggaccaaacgcaacgatcatagacaccatgctatggacgccctcacagtggccttcaccaagcccagctacattcagtacctgaatcacctgaacgctcggaaagacgaaaataacaagaattattccgtcatccttgccattgagaaaaaggaaaccatcaaggtgcccacaaacaatgggaaaaacaagcgcgtgtttatcgagcctattccgaacttcagacaggttgcgaaaaagcacctggaggaaatctttatttctcataaagctaagaataaggtcgtgacgaaaaacaccaataagcccgccggcacaaacaaacaacagatcaccctcacacctcggggacagctgcacaaggagaccatttacggcaaatatcagtactatgtgaataaggaagagaaggtcggggtgaaattcgataaggaaacgatcgccaaagttagcaaccccctctaccgcgaggctctgcttaagagactgcaagccaatgacaacgatcctaaaaaggcgtttacaggaaagaatgctctctccaaaaaccccatctatctggacgaggccaagaccaaaaccctgccggaaaaggtgaatcttacatacctggaggaagatttctctgtccggaaaaagattgtgcctaaaaaccccaccagcaaggagtttgttcctaatctcaagtccatcgaaaaagtggtcgacgagggcgtgcgcaacattctgatcgagagactccgggtttacaataacgatcccgaaaaggccttcgtggacctggagaaaaatcctatttggcttaacaaggaaaaagggatcgctattaagagagtcacaatcagcggagtgaacaatgcccagcccctgcatatcggcaaggatcacctggggaaaacgaccctcaacaaggagggcaaagaaattccggtggactatgtctctacaggaaataaccaccatgttgctatctaccgcgataaggagggcaatctgcaggagcagattgtgtccttctttgaagccgtggtccggacccaacaggggcttcctatcattgacaaaacatataagcaggaggaaggatggcagttcctgtttaccatgaagcaaaacgagatgttcgtgtttcccaatgaggcgacgggcttcaaccccgccgaaatcgacctcctggatcctaaaaataagaaacagatcagcccgaacctctttagagttcagaagattgctaccaaagactacttctttcgccaccatctggagacaaatgtggaaaccgataacgtccttaagaatacaacctggaagcgggaggggctgtctggactgaaagacatcgtgaaggttagaattaaccacctcggcgatatcgtgtccattggggaatattga

SEQ ID NO: 4513 - RNA, 4302 nt, synthetic construct
  misc_feature 1..4302: note = Cas9 variant
  source 1..4302: mol_type = other RNA
atgaagaaaatcctgggcctcgacctggggaccacaagcattggatacgcccaggtgaacgagtccgaagatttcaaggactctagcatcgagagaattggcgtccgggttaatcccctttccgtggatgaacaaacgaactttgagaaagggaagcctatctctattaatgctgaccgcaccctgaaaagcggagccagacggacactcgatcgctatcaggacagacggtccaacctgatcgatgcgcttgtgaagtctgtcatcattaccgaagacacagtgctggctgaggatggcaagaataccacacacagcaccttcgccctccgcgccaaatccgctagcgagaaggttgaaaaagccgagtttgctagaatcctgctggccattaacaagaaacgggggtacaagtcttcccgcaagacgaataacaatgacgatgaaggacaggcgatcgacggcatggccattgctaaaaagctctatgatgagaacctgaccccgggccagcttgcctaccaactgctcaaagaggggaagaaatatctgcccgacttctacagaagcgaccttcaggctgaatttgataagatctggacattccagaaacagttttatcctgagattctgaccgacgaactccaaaaggagctggccggaaagggccagcgggcgacatctgccatcttctggaaaaagtacgattttaataccgctgaaaacaaagggacgcgcgaggagaagaaactgaaggcctacgaatggagatccacaagcgtggacaagaaactccagaaggaggaagtcgcttatgtgatcaccgagattaataacaatctgacaaactcttccggataccttggcgccatcagcgatcggtccaaagaactgtatttcaacaagcagaccgttgggcaatacctctttaaacagattcagaagaatccccataccaagctgaaaaaccaagtgttctatcgccaggactactttgatgagttcgagatcatttgggaaacacaggccaagttccaccctgagcttacggaagaactgaaaaataagatcagagacatcattatcttttatcagcggaaactcaagtctcaaaagggactgattagcttctgcgaatttgagagaaaagaggtcgaaatcgagaagggcggccgccggatgaaaaagaccattgggctgaaagtggctcccaagtccagccctctcttccaggaatttaaaatctggcaagtgctgaacaatgtccttatcagaaagaagggatctaaaaagcgccgggttaaagagccggatcagctgaacctcgtggagcaggaacaggaggtgatgttctttgacatgcagacaaagcagaccctgttcgatgaacttaatgtcaaaggcaacctgaaggcgaagagaattatcgagctcattgggcaagacgccaatgactgggaaatcaactactccgagattgagggaaatcgcacaaacaaagctctgtacgatgcctatctgaagatcctcgacctggaaggctacgataccaaagcccttctggacgtgaagacgagcaaagatgaggttgaactcgacgatattaatatctctgggcccgaggtgaaggacctggtcaagcggatctttgaaagcctggagattgatacacagatccttgagttcgacgctgaactcgatggagaggtgtttgaaaaacagtcctcttatctgctgtggcatctcctgtacagctatgagggcgacgattcccctagcggcaacgaaaaactttacaaactgctcaagcagaaattcgggtttaagaaggagcacgcccaaattctggcgtctatcaccctgtccgacgactatggaagcctttctgctaaagccatgagaaagatttacccctacatccgcgagcagaccttcgataaagccgcttccctcgccggctatcggcatagcgcttcctctctgacaaaggaagagatcgccaatagacctctgaaagacaagctcgaactgattaaaaagaacagccttcgcaaccccgttgtggagaagatcctgaatcaggtcgtgaacattgtcaattccctcatcgaggcgaactctgaaaaagatagcgacgggaatattatctcctacttcaagtttgatgagatccggattgaactggccagagacctgaaaaagaacgctaaagagcgggccgaaatgacccttaatatcaacgctgccaagattgtgcacgagaagatcttcaaactcctgcaagcggagtttggagttaagaatccgacacgcaacgatattatcagatataaactgtacgaagaactcaagaataacggctataaagacctgtacacgaatatctatattcctcgggaaatccttttcagcaagcagattgatatcgagcacattatcccccagtctaagatgtttgacgattccttcagcaacaaaaccattgtgtttagaaaggacaatctggataaagggaactctacagccttcgactacatcgactcccgctttggcaaggataaactcaccgacttcgaacagcggatcgagtttctgttcgagcaaggaaagaagaacaaagaagagggcattagcaaggctaaataccagaagctgcttaaaagagaagccgatatcggggacggatttattgagcgcgatctcagagacacacagtatatcgctaagaaggcccggaatctgctgtacgaaatttgtcgcatcgtcacccctacgaccggctctatcacagatagactccgggaggactgggatctggtgaacattatgcaggagcttaatctggacaaattcaagaaactcgggctgaccgaaatggttgagaagaaagatggcagcttcaaggaacgcatcgtggactggtccaaaagaaacgaccatcggcaccatgccatggatgctctgacaattgcgtttaccaagcacagccacatccaatatcttaattacctgaacgcccgcaagaatgagaaccataaacagcaccataatattatcggaatcgagagaaaggaaacggagttcgtcattgacgatctcgggaacaaaaagcggaaatttcatctgcccctccccaatttccgcgaagaggctaagaagcacctggaaaacgtgcttgtgtcttttaaagccaagaataaagttgtcacaaagaacaaaaataagaccgcctccagcaagggcgagaaaatcaaggtggagctgacacctagaggacagctccacaaagaaaccgtgtatggcaagtacaaattctatgtctccaaggaggaacggattgggggaaagtttgaccagagaaccatcgagcgcgtggctaactctacacacaaacggctgctgcttcaaagactgctcgaaaacgataatgacgccaagaaagcgttcacgggcaagaacgctctggccaaaaatccgatttacctcgatgacaccaagacactgacccttcccgagatcgttaaactgacatggctcgaggaagattacagcattcgcaaggacatcacccctgagaactttaaggatatcaaagtgattgacaagatcctggatgaaggggtcaaacggattctgaaggagagacttgccaaacataataacaatcccaaggaggctttctccgacctggagaagaaccctatctggctcaatgagaaaaagtctattagcatcaaaaaggtgaaaatctccggaattaacaatgccgaagcgctgcactataagaagaaccatctcggcatcgagattctggacgatgagaaaaagcgcatccccgttgactttgtgtctacggggaataaccaccacgtcgctatttaccgggatgagaaaggcaatcttcaggaggacgtggttagcttcttcgaagccgtggccagagtcaaccagaatctgccgatcatcgataagacactgaaggcttatctcggatggacctttctgttcaccatgaagcaaaacgagtactttattttccctaacaagcagacaggctttaatcccaccgaaatcgaccttctggattccatgaacaataaactcattagccctaacctgttccgcgtgcagaagtttacagtgaaagactatttctttcggcatcacctcgagacgaatgtcgaagatgactctaagctgaaaaacaccacatggaagagagaggggcttggaggcatcgggaatattgttaaagtgcggatcaaccatattggacagatcgtgaagatcggcgagtactga

SEQ ID NO: 4514 - RNA, 4305 nt, synthetic construct
  misc_feature 1..4305: note = Cas9 variant
  source 1..4305: mol_type = other RNA
atgaagaacatcctgggcctcgacctggggaccaatagcattggatgggcctacgtgaaacaggctcaaaacgattccgagaagtctgaaatcgccgagcttggcgtcagagttaatcccctgacagtggacgaaaagacgaacttcgagaaggggaaacctattagcaccaatgcggatcggacactcaagcgcggagctagacggaacctgcagcgctataaacttagacggcaggaactgatcgagctcctgaaagactaccaggtgatttccgataagaccatcctggccgaggacggcaaagaaacaacctttgagacactccgcctgagagtcaagtctgccaaagaacaagtgagccttgaggagctggctcggatcctcctgatgattaataagaagcgcgggtataaatcctctagaaaggccaaaaacgaagatgagggacagcttatcgacggcatggaaattgctcggcgcctgtacgatgagaatctcaccacgggccagctgagcctgcagctcctgaaggaagggaaaaagtcccttccggactattacagaagcgatctgcaacacgagctcgacaaagtttggaacttccagaagcagtttcatcccgatatcctgaccgacgagttctatacatctattcagggaaagggccaaaaagccacccgggaatcctttagctctaagtacgggatcgacacagcggagaataaaggatcccgcgaagagaagaaacttcaggcctaccagtggagagctgatgccacccacaaggaactgacgaaggaggagctcgctttcgtgattacagaaatcaacaataacatcaataacagctctggctatctgggggccatttccgaccggagcaaagagctgatctttgcgaacgaaaccgtcggagagtacctctggaagcaaattcagaatgatcctcatacatccctgaaaaaccaggtgttctatagacaggactactttgatgaatttgagcgcatctgggagacccaatctggcttttatccccagattcttaccgaaagcctgaagaatgagctccgggacatcctgatcttctaccagagaaaacttaagtcccagaaggccctggttagcatttgcgaatttgagtctaaagagatccctctcaaggataaacaaggcaaccccatttccaagaatgggatccctgtgacaaaactggtcggaccgaaggtggctcccaagagctctcctctgttccaggagttcaaaatttggcagaacctcaataacgtgctggtccgccccaagggcagccggaaaagaaaggttacgaccaatcagcaatccacacttctggaagggcaggaacctgtgtttgagctcaacctggaacagaaagagctgcttttcgaggaactcaatctgaagggaaacctgaaaaccgactattgtctcgagctgatcggctactctgccaaggaatgggagatgaattaccccacacttgaagggaacaagaccaataaagctctgtatgaggcctacctcaagatcattgatagcgagggatatgacgccaaaaagctgctgaaagtgaagacggataaggacgacatcaaccttgatgacattaaagtctccgctagcgaaatcaagacaatgatttctgatatctttaacgagctcggcattaataccaaaatcctggacttcgatgcggaactggagcgcaagcagtttgaagcccaggcttcctaccggctctggcatctgctttatagctacgagggcgacgattctaaatccgggaacgagctgctctatagactgctggaagacaagttcggatttaagcgcgagcacagcaaaacccttgccaatgtgtccctcctgtctgattacggcaacctgagcacaaaggccatccggaccatttacccgtatatcaaagaaaataagttctccacagcttgcgagctcgccgggtacagacactctaaactgagcatttccaaggaggaaaacgagaatcgcacgcttaaggacaccctggatgttctcaaaaagaacagcctgcggcaacctgtggtcgagaaaatcctgaatcagatgattaaccttatcaatgaactcatcgaaaagcactctgagaaagacgagaagggaaacattgtgaaatattttaagttcgatgaaatccatattgagctggcgagagaactgaagaaaaatgctgaggaacggcgcgagctcgactccaaggttagagagggcaaagaccggaacgaaaagatcattacaatcctgaaaagcgagtttgggcttccctaccctaccaagaatgatatcacaagatatcgcctgtacgaggaactcaaggacaacggctataaagatctgtacaccaacacgtacattccccgggaaaagctgttctctaaagagatcgacattgagcacatcattcccaagtccagactttttaatgatagcttctctaacaaaaccatctgttatcgccaagacaatctgaacaagggagaaagaacagcctacgattatatcgagggcctcgggaagacccagctggacgaatacctcaatcgggtggagaacctgtatacaaataaattcattaccaaggccaaataccgcaaccttctgaagaaagagagcgaaatcggagatggctttattgagagagacctccgggaaacgcagtatatcgctaagaaggccaaagagatgctgctgcagattacacgccatgtcgtgtccaccacagggagcatcaccgatagacttcgggacgattgggaactggtcaatgtgatgcgcgagctcaacctgcctaagtacaaagttctcggactgaccgagattcaagaaagaaagaatggccagacagtggaggtcatcacggactggaccaaacggaacgaccaccgccaccatgctatggatgcccttacagtggcgttcaccaagcactctcatatccagtacctgaattttctcaacgccagaaaggacgaaaaacacaaggagtattccaatattatggggatccagcaactggaaacagagaaaaccacggataaggacggcaaagatcggagagttttcaagacaccgattcccaactttcgccaggtggctaaagagcatctggaaagcatccttatttcccacaagaccaagaacaaagtcgtgacccgggccacaaataagatcgctggatctaaaaagcagcaggagaccctgagccctagaggccaactccacaaagaaacagtgtacgggaagtatcgccggtacgttcagaaggaggagaaaatcggatccaagttcgacctgcagacgattgaaagagtcgccaaccccctctataaacgcctgcttaccaagcggctggaggaaaatggcggggatcctaaaaaggcgtttacaggaaagaacgccctggctaaatctcccatctacctcgacgagacccaaacacagcagctgccggaaaaggtgaaacttgtgtggctggagaccgatttcagcattagaaaggacatcacgcctgataattttaaagacgagaagtccattgacaaggtcctcgatgaaggcatcaaacgcatcctgaaggaccggctcaaatctttcgatggggacgccaagagagcttttaccgatctggagcagaaccccatttggcttaataaagaaaagggcatcgccattaaacgggtgacaatcagcggagtttccaacgccgagcctctgcataccaagaaggaccacctgggcaatgaaattttcgatgacacagggaaacccatccctgtggattatgtcagcaccggaaacaatcatcacattgctatctaccgcgacgagaacggcaatctccaagagaaggcggtgtctttcttcgaagccgttacaagagctaaccaggggctgcccaccgtggataaaacgtacaatcagcaccttggatggcagttcctgtttacaatgaagcaaaacgagatgttcgtctttccgaataaagaaaccggcttcgaccctcaggagatcgatctcctggaccccaagaacaagaaactcatttcccccaacctgtttcgggtgcagaagatcagcaccaaaaattatttctttcgccatcaccttgaaacatctgttgagacccataacgccctgaatggggtgacgtacaagtcccagctgggcctcaacggaattacagacatcattaaagtcagaatcaatcacctgggcgatatcgtgcatattggggagtattga

SEQ ID NO: 4515 - RNA, 4308 nt, synthetic construct
  misc_feature 1..4308: note = Cas9 variant
  source 1..4308: mol_type = other RNA
atgctgggctgcgagagaaagcggaaacgcagagaaaaggagaaaatggccaagcccaaagactacaccatcgggctcgatattggaacaaacagcgtgggctgggtcgttacggacgatcagaataacatcctgcggattaaggggaagaaagctatcggagcccgccttttcaccgaaggcaaggtggcggctgagagacggtcctttcgcacaaccagacggcgcctgtctagacggcgctggagaattaaaatgctcgaagaactgttcgacgaggaaatcgccaaggtggatcctagctttttcgcccggcttcacgagtcctggatctctccgaaagacaagcgcaagagatatagcgctattgtctttccctcccctgaagaggataaaaagttccatgagtcttaccccacaatctatcatctgcgggacaaactcatgaaggatgaccaaaaacacgatattagagaaatctacattgccgtgcaccagatgatcaaggctcgcgggaattttctgcatgacgagagcgttgaaacctatcggtccggaatgagctctctgggcggcagatccgagcgcaacattctcagcgtgcagacactggaagaacttaatgatctgttcgccgagaacgaagggaccgaggaagtcgagctcaatgtggcgtctgccgaacagatcaacgacatcctgacgggaggccaccttaatgctgactcccaaaaagagattagcaacctgctcctgccttcttcctttcccagcttcgatgacaaggccaaggagaaacaggttaagaaactgatcaataacgtggctaccaatatttccaaggcctggctcgggtacaaagcggatttttctacaatcctgaaccttgccaaggtcgacaaggatcagaaaaagattttcgcttttgccctgcagggaggcgacgaagaggataaagtgcaagaactcgagagcctgcttgaacagtcccagaccgacatcgtggatcggctgatcgagattagacacgctatcgtcctcagcgagattgttcctgtggggatgacactgtctgaagccatgatcgacaagtatgatcagcataaagaggacctgattaccctcaaggccgtgatccgcaatacgaaggacaaaaagaaagctgcgaagctgcaagccatctacgatctttacgtcaaaaaccggcacgctgacctggccaaggccatgaagctcacaggaattaaaaagagatccgaactgcttgatccggaggagctgaaaaagggcatcagctctctcctggacgatagccccgaagctgtggagattaaacagcgcctggaagagaagaccttcctccctctgcagcggtccaacaataacggcgttatccccaatcaacttcatcaggtggaactggacgagattatcaaaaagcagtctaagtattaccctttcctcgccgagaaaaaccccgatgaaagcgaggaagcgcagaagaaagctccgacaaagctggacgccctgcttacctttagagtcccttattacgtggggcccatgattaccaaagaggaacaagaggcccagaatggacactccttcgcttggatggttcgccgggatcctcaggaccacgaggccatcacaccctggaactttgaaaagaaggtggataaaatggctagcgccacgcagttcatcaagagaatgaccacaaaagacacctatctcctgggcgaggatgtcctgcccgcgtcttccctcaagtaccaactgtttacagtgcttaatgaactgaacaatctccgggtcaacgggaaaaagctgaccagcgacgagaaggaacaggtgattgagggactgttcaaaaagcagaaaacggttaaggccgacaaatttgtgaagtattggcaggctaagcatatcggcgccgatattaaagtcaaggggctttctgacccttccaaattcaatagcacaatgtccacctacatcgattttaagaaaattttcggagaccaactcaacgatgtgaatcgccagaacgactttgagaagatcatcgaatactctaccattttcgaggatagaaaaatcctggaagacaagctgcgggttgattttgcttggctcagcgaggagcagattaagcagctgtgtagacttcgcctgcaaggctggggccggctctccgacaaactgctgacaagacttaccgatgccgacgggcagaatgtgctcgaacgcctgtggaactctaacgataatttcgtccagatcgtgagcgacccgaacattaaggcgaaaatcgagcaagaaaatcagaagctgctcagagactcccagagcgataacgccgtggagtctatcctggacgatgcttatacaagcccccagaataaaaaggccattcggcaagttatgcgcgtcgtgcacgacatcgtgaaggcttgcgatggaaacgtccctgccaaattcgccattgaatttgctagatcccaggaggacgatcccaagcggacgaccgcgcgcgtgaatcagatgcagaaaatctacgaccaaatttctgatgaggttgtgtcccagggcgtcaaggaacagcttagcgggatgaaatctctgaaggacagatattacctctatttcatgcagggaggccgggatgcctacacaggggctaagctgaacatcgaccgcctgagcgactatgatgtggaccatatcatgcctcaatcctttgttaaagatgacagccttgataatagagtgctcgtcgcccgggccgtgaacaatcagaagtctgacaaagttcccgctctgctgttcggcaacaaggtggtcgccgatctcggaattaccgtgcgcgagatgtgggacaaatggcagaagctgggcatgatctccaagagaaaacttagcaatctgctcacagattccgacgcgctgaccgaataccgggctcaagggtttattagacgccagctggtggagacgtctcaggtcatcaaacttaccgccacaattctgcagagcgagttcccggattccaaaatcattgaggttcctgccaagtacaactctatcgtgcggaaacaatttgacctctataagagcagagaggtgaatgatttccaccatgctatcgacgcctacctgtccaccattgtcggaaactatctctaccaggtgtatcccaacctgcgccggatgtttgtttacggcgagttcaagaaattttctagcaatgcggaggaatccgctcacgacgtggccagacgcgtcaagagcatgaacttccttgatgacctgctccgggggacacacggagataatatctattgtagatctaccggcgagattgtgtttaaccgcaatgacatcatttccaaactgaagcaggcctacagcttcaaacagatgctggttacgcaagaagtgttcacaaagaaatctgctctttttaaccagaccgtctacccttcccccaagcgggatgggagcaagagatctggcctgatccctcggaaacgcggaatggaccccgagatctatggcgggtacgcccataatcaggattcctatttcgtgctcgctaagattgagaaagttaagggatacacactgcagatcgtgggcgtcccgattagaagcctcgaaatcattaacaaagccgaggacttttccaccgcgctgcttgatatcatcaagagcaaggtgatgtataatgaaaagaccgggcaacctaagcggggaattaaaaacgtggagatcctggtcaataagctcccctaccgccagcccattctggagaaagacgtttcttatatgctgggcagctccgcctacaagtacaacatcaagcagattacactttctagacagagcatgaaatatatcctggattacattgacgatcctaatttcacgaagcacgaaatgaccatgatcgacgagcaaaacgaacgggagtgcctcctgtccgtgtatgacgaaatcctcgagaaagtggataagtacctgccgctttttgacgggaataaattcagagagaagctgcattctgctcgcaaggaatttgtcagcctgtccgtggatgacgaggcctctgctattgagaaaatcctccggggcctgcacgccaacagcgaaatgccctcccttgaaaacctgaagattaaacctgccctcggattctttcagatgaagaatggcatcacactgagcaacgatgctgttctcctgtatcagtctcccaccgggcttttcgagagacgcgtgaaagtctccgacctgctgaagtga

SEQ ID NO: 4516 - RNA, 4308 nt, synthetic construct
  misc_feature 1..4308: note = Cas9 variant
  source 1..4308: mol_type = other RNA
atgaagaacatcctgggcctcgacctggggaccacaagcattggattcgcccacatcgtggaggatgaaaataaagagaagtccgaaattaaagagcttggcgtcagaatcgttcccctgacgaccgacgaacagtctgattttgagaaggggaaaagcattacaaccaacgctaatcggacactcaagcatggagcccgcctgaaccttgacagataccaacagcggcgcaagtatctgatcgatctcctgcagaaagcgaatctgatcacctcctctagcattctcgctgagaacggcaagaatacaacccactccacgtggcagctgagagccaaagccgtgaccgaacggatcgagaaggaagagttcgctcgcgtgcttctggccattaacaaaaagagagggtacaagtctagccggaaagctaagacagaggacgaaggacaagccatcgatggcatggcgattgccaaacgcctctatgacgagaatctgaccacaggccagctttccctgcagctcctgcagcaaaacaagaaactgctccctgatttttacagaagcgacctgcagaaggaatttgatcttgtctggaattttcagaaacagttctatccggacatcctgaccgattctttttacaaggagctccaagggaagggaaaagacgctacgtccaaggccttcagcaaacggtatcattttgacacagctgaaaacaagggctctaaagagtccgtgcgcctgcaggcctaccagtggagagttgaggcgattagcaagcaactttctaaggaagaggtggcctacgtcctgaccgaaatcaataacaatctcaacaacgcttccgggtatctgggagccatcagcgatcggtccaaagagctgtacttcaatcgccagacagtgggccagtatctctacgctcagctgcaagaaaacagacacaattctcttaagaacaaagttttctatcggcaggactacctggatgagttcgagagaatttgggaaacccaggccagctttcataaggagctcaccgaggaactgaaaaagcagatccgcgacgtggtcattttctatcaacggaagcccaaatcccagaaggggcttatcagcttctgcgaatttgagtctaaagagattgaaatcgagaaggatggaaaaacaatcacgaagaccattggcgccagagtggtgcctaagtccagccccctgttccaggaatttaaaatctggcagattctcaataacgtcatctgtaagcgcaaaggcattcggaagaaaaaggtttctgctaaaacaacccaactggacctgctcaatgagagctcccagacaatcttctctctggatatggagtgcaagcagcttctgtttgaggaactcaacctgaagggggacctgaaaagcgataaggtgcttaaactcctgggatactcccctcaggaatgggagatcaattacaaccaactggaaggcaatagaacccagaaggcgctctatgaggcctacctgaaaattgtggagatggaagctcacgacgtcaaggatatccttcagattaagagcgccaaagacgactggtctctggatgagagccccctctccgcctctgaaatccgcgagtccgtgaaggctattttccaagccctggggatctgtacgaaaattctgtattttgaccctcttctcccggttaaggagttcgaaaaacaggatagctaccagctgtggcatctgctctattcctacgagtctgacgatagcacatccggaaacgaaaccctgtatcggatccttgagaagaagtacgcgtttaaaagagaacacgtgcgcatcctggctaatgtcgccctccaggacgattacggctctctgagcaccaaggccattcggaaaatctatcccaacattaaggagaatcaatactccatcgcttgcgaaatggccgggtataaacacagcaagctgtctcttacaaccgaggagctcgaagctagagagctgaagaacattatccctctgctcaaaaagaacgccctgcgcaatcccgtggttgaaaagatccttaaccagatgattaatgtggtcaacgcgctgatcgagaaaaattccgagcgggacgccgaaggaaaaattacaaagtacttccattttgatgagatcagaattgaactcgctcgggagctgaaaaagaacgcccagaagcgctatgaaatgacgcagaatatcaacaaagctaagctggagcaccagaaaatcagcgagattcttcaaaagcagttcggcatcaaaaatcctaccaagtctgacattatcagataccggctctatcaggaactggagcacaacggctacaaggaactgtacacaaatgcctatattgcgcccgatgtgctcttttccaaaaacatcgacatcgagcatattgtcccgaaggccagagtgttcgatgacagcttctctaataaaaccctggcttttcgcgagttcaacatcaagaaaggggaaagcacagcctttgactacattacctcccttaatagcgaggaggaactgaaccaatatctcacgcgggttgaaaacgcttacaagaccaagtctatctcccctacaaaatataagaatctgctgaaaaaggccagcgagattggagatgacttcatcaacagagatcttcgcgacacccagtacattgccaaaaaggctaaggaaatcctgtttcaggtgaccaaaaatgtcctctccacatctggcagcatcacggatagactgcgggaggactgggggctcgtggatgttatgaaggagctgaacatgcccaaatatcaatcccttggactgacagaagtggaggaacgcaaggacggcaataaagtcaccgtgattaagaactggacaaagagaaatgatcaccggcatcacgcgatggacgccctcaccgtggctttcaccaaaccttcttacatccagtacctgaaccatctgaatgcccgcaaggatgagaacaataaaaactatagcgttattcttgccatcgaggaaaaggagacaattaaagtcagaacgaataacgggaagaataaacgggtgtttatcgaacccatccccaacttccgccaggtggctaagaagcacctggaggaaatttttatctcccacaaaaccaagaacaaagtcgtgacaaagaatgttaacaaacctgccggcaccgacaagcagcaaattacactcaccccgagaggacagctgcataaggagacgatctacggcaaatatcagtactatgtgaataaggaggagaaaattggggtcaagttcgataaagaaacaatcgcgaaggtgtctaaccccctctaccgggaagctctgcttaagcgcctgcaggccaatgacaacgaccctaaaaaggcctttaccgggaaaaatgctctcagcaagaaacccatctatctggatgagtccaagaccaagacactgcctgaaaaagttaaccttacctacctggaggaggacttcagcattagaaaggatatctctcccgacaattttaaagatctcaagtccattgaaaaagtgatcgaccaaggcgtcaagcggattctgatcaaaagactccaggcctacgataacgacccgaagaaggcgttcgtggatctggagaaaaatcctatttggcttaacaaggaaaaagggatcgctatcaagcgcgttacaattagcggagtgaataacgcccagcccctgcacatcggcaaagaccatctggggaagacgaccctcaataaggagggcaaagaaattcctgtcgattatgtgtctacaggaaacaatcaccacgtggccatctaccgggacaaggagggcaacctgcaggagcaaattgtctccttctttgacgctgttgtgagagcccagcaggggcttcccatcatcgataaaacctataagcaggctgaaggatggcaattcatgtttacaatgaaacagaacgagatgttcgtgtttcctaatgaaaccacgggcttcaaccccgccgagattgacctgctcgatccgaagaataagaaactgatcagccctaacctctttcgcgtccagaccatttctgtggttaagtacggaaattccgtggtccgggacttcaaatttagacatcacctggagacaacccttcaagatgacaagatcctgcagggaattacattccagcagatcaaaagcctggaacccctccgcaacatcgtgaaggttcggattaatcatctgggcgatatcgtgtccattggggagtattga

SEQ ID NO: 4517 - RNA, 4308 nt, synthetic construct
  misc_feature 1..4308: note = Cas9 variant
  source 1..4308: mol_type = other RNA
atgaagaacatcctgggcctcgacctggggaccacaagcattggattcgcccacatcgtggaggatgaaaataaagagaagtccgaaattaaagagcttggcgtcagaatcgtttctctggctacggacgaacagagcgattttgagaaggggaaatccatttctaccaacgccaatcggacactcaagcatggagcgcgcctgaaccttgacagataccaacagcggcgcaagttcctgatcgatctcctgcagaaagctaatctgatcaccagcgcctccattctcgccgagaacggcaagaatacaacccactctacatggcagctgagagctaaagccgtgaccgaacggatcgagaaggaagagtttgctcgcgtgcttctggccattaacaaaaagagagggtataagaatagccggaaaacgaagaccgaggacgaaggacaagcgatcgatggcatggccattgctaaatgcctctacgacgagaacctgacacccggccagctttccctgcagctcctgcagcaaaataagaaactgctccctgatttctatcgcagcgacctgcagaaggaatttgatcttgtctggaacctgcagaaacagttctacccggacatcctcaccgattctttttataaggagctgcaagggaagggaaaagacgccacatccaaggctttcagcaaaagataccattttgacaccgccgaaaataagggctctaaagagtccgtgcggcttcaggcgtatcagtggcgcgccgaggctattagcaagcaactgtctaaggaagaggttgcctacgtgctcacggaaatcaacaataacctgaacaattccagcgggtacctgggagctatctccgatagatctaaagagctctatttcaaccggcagacagtcggccagtacctgtatgcccagcttcaagaaaatcgccacaacagcctgaagaataaagtgttttacagacaggactatctcgatgagttcgagcggatttgggaaacccaggcctcctttcataaggagctgacagacgaacttaaaaagcagatcagagatgttgtgattttctaccaacgcaagctgaaaagccagaaggggctcgtctctttctgtgagtttgaatccaaagagatcgagattgaaaaggacggaaaagctatcaccaagagcatcggcgcgcgggtggtgcccaagtctagccctctgttccaggagtttaaaatttggcagatcctgaacaatgtcacatgcaagagaaaaggcattcgcaagaaaaagtcctctgccaaaagcacagaactcgatctgttcaacgagccctcccaaagcatcttttctcttgacatggagtgtaagcagctcctgttcgatgaactgaatctgaagggggaccttaaatccgataaggttctcaaactgctgggatatagccctcaggagtgggaaattaactacaatcagctcgagggcaaccggacgcaaaagtctctgtacgaggcttatcttaaaatcatcgaaattgaggggtacgaagtgaaggacatcctgcagattaagtccaccaaagacgattggagcctcgacgagtctcccctgtccgccagcgaaatcagagagcgcgtgaaggtcatttttcagacactgggaatctgcaccaaaattctttatttcgatcctctcctgccggtgaaggaatttgagcaacagtactcctatcagctgtggcacctcctgtactcttatgagagcgacgattccacaagcggcaatgaaaccctttaccggatcctggagaaaaagtacgccttcaagagagaacacgctacgatcctcgccaacgttgcgctgcaggacgattatgggtctctgtccacaaaagctattcgcaagatctacccctatattaaagagaatcaatacagcaccgcctgtgaacttgccggatataagcattctaaactctccctgaccacagaggagctggaagctcgggagctcaagaacatcattcctctgcttaagaaaaacgccctgagaaatcccgtggtcgaaaagatcctcaaccagatgatcaatgtggttaacgctctgattgagaaaaatagcgagcgcgacgccgaaggcaagatcaccaaatactttcacttcgatgagattcggatcgaactggcgagagagcttaagaaaaacgcccaggaacggtatgagatgacacagaatattaacaaggctaagctcgagcatcagaaaatctctgaaaagctgcaaaaacagtttggcatcaagaatcctacgaaaagcgacattatccgctacagactgtaccaggagctcgaacacaacgggtataaggagctgtacaccaatacatatattgcccccgatgtgcttttctccaagaacatcgacattgaacacatcgtcccgaaagctcgggtgttcgatgacagcttttctaataagaccctggccttcaaagagtttaacatcaagaaaggagagtccacagcgttcgactacattaccagcctcaattgcgaaggcgagctgaaccaatatctgacgagagtcgaaaacgcctacaagaccaagtccatctctcttacaaaatataagaatctgctcaaaaaggctagcgagattggggatggatttatcaaccgcgacctgcgggatacccagtacattgccaaaaaggctaaggaaatcctcttccaggtgaccaaaaatgttctgtccacctctggcagcattacggacagacttcgcgaggattgggggctggtggacgtcatgaaggagctcaacatgcctaaataccaatccctgggcctgacagaagtggaggaaagaaaggatggaaataaagttaccgtgatcaaggactggacaaagcggaacgatcatcgccaccatgccatggacgcccttaccgtcgcttttaccaaaccctcttatatccagtacctgaatcacctcaacgcgagaaaggatgagaataacaaaaattatagcgtgattctggccatcgagaagaaagaaacaattaaggtgcctatcaacaatggcaaaaacaagcgggttttcattgagcccatcctcaattttcgccaggtcgctaagaaacatctggaagagatcttcatttcccacaaggccaaaaacaaggtggtgacgaaaaacatcaataagcccgccgggaccgacaagcagcaaattacacttacccctagaggacagctgcacaaagaaacaatctacggcaagtatcagtactatgtcaacaaagaggagaaggtgggggttaaatttgatgaacggaccattacgaaggtgagcaatccgctctaccgcgaggctctgctgaagagacttcaggccaacgacaatgaccccaaaaaggcgttcgctggcaaaaacgccctgtctaagaatcctatctacctcgatgaagccaaaacaaagaccctgcccgagaaggtcaacctcacctatctggaagaggacttttccatccggaaagatattagccctgacaatttcaaggatcttaaatctatcgagaaggtgattgaccaaggagttaaacgcatcctgattaagagactgcaggcttacgataacgaccccaaaaaggccttcgtggatctcgaaaagaatccgatctggctgaacaaagagaaggggattgcgatcaaacgggtcacaatctccggcgtgagcaatgctcagcctcttcatattggaaaggaccacctgggcaaaaccacactcaacaaggaagggaaggaggttcccgtggattatgtctctacgggaaataaccatcacgtggccatctacagagacaaagaaggcaatctgcaggagcaaattgtgtcctttttcgaggccgtcgttcgcgctcagcaggggctccctatcattgacaagaactataaacaggccgaaggatggcaatttatgttcaccatgaagcagaacgagatgtttgtgttccccaatgaagctacaggctttaaccctgccgagatcgatctgcttgaccccaaaaataagaagctgatcagcccgaacctgttccgggtgcagaccatttccatcgtcaaatacgggaatagcgtggttagagattttaagttccgccaccatctcgagacaaccctgcaagacgataaaattcttcagggcatcacgtttcagcagattaagtctctggaacctctccggaacatcgtgaaagtcagaatcaatcacctgggagacattgtgaacatcggcgagtattga

SEQ ID NO: 4518 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagaactacacagagtggaataaagaaaaggggaaaaccgagcagcaagaacgcgagcataagctcgaaggaatctacagcaaacggaagagagatgaggccaagcgcgagaacctgcagtggcgggtgaacggcctgaaagaaaagctctccctggagcagcttgtcattgtgttccaggaaatgaatacacaaatcaacaatagctctgggtatctgggagctatctccgacagaagcaaagagctctactttaacaagcagaccgtgggccagtatcagatggagatgctggacaaaaatcctaacgcctctcttcgcaatatggtcttctaccggcaagattatctggacgaatttaacatgctctgggagaagcaggctgtttaccacaaggaactgaccgaggaactgaaaaaggagattagagatatcattatcttctatcagcgccggctcaaatcccaaaagggcctgattgggttttgcgagttcgaaagcagacagatcgaggtggacatcgatggcaaaaagaagattaaaacagtgggaaatcgcgtcatctctcggtccagccccctttttcaggagttcaagatttggcagatcctgaacaatattgaagtgacggttgtggggaaaaagagaaaacggcgcaagctcaaagaaaactactccgccctgttcgaggagctgaatgacgcggaacaacttgagctcaacggatctagacggctgtgtcaggaagagaaggaactgctcgcccaggagctgtttgtcagagataagatgaccaaaagcgaggtgcttaagctcctgttcgacaatcctcaggaactggatctgaactttaaaacaatcgacggcaacaagaccgggtacgctcttttccaagcctattccaaaatgatcgagatgagcggacatgaacccgttgattttaagaagcctgtggagaaagtcgtggagtacattaaggctgtcttcgacctcctgaattggaacacagacatcctgggctttaattctaacgaggaactcgataatcagtcctattacaaactgtggcaccttctgtatagcttcgaaggcgacaacaccccgacggggaatggacgcctcattcagaagatgacagagctgtacggctttgaaaaagagtatgccaccatcctggccaacgtgtctttccaggatgactacgggagcctttccgctaaggcgattcataagatcctcccccacctgaaagagggaaatcggtacgatgttgcctgcgtgtatgctggctacagacactctgaaagctccctgacccgcgaggaaattgccaacaaggtcctcaaagacagactgatgcttctgcctaagaatagcctccataaccccgtggttgagaaaatcctgaatcaaatggtgaacgtcatcaatgtgattatcgatatttatgggaagcctgacgaaatccgggtggagctggcccgcgagcttaagaaaaacgctaaggaaagagaggaactcacaaaatctattgcccagaccacaaaggcgcacgaggaatacaaaacgctgctgcagaccgagtttggcctcacaaacgtttcccggaccgatatcctgcgctataaactttacaaagagctggaaagctgtggatataagacactctactctaatacctacatctccagagagaagctgttcagcaaagaatttgacattgagcatatcattccccaggctcggctgttcgatgactccttctctaacaagacgcttgaggcccgcagcgtcaatatcgaaaaaggcaacaataccgcctatgattttgtgaaggagaaattcggggaatccggagctgacaactctctggagcaatacctcaataacattgaagacctgtttaagagcggcaagatctccaaaacaaagtataataaactcaagatggccgagcaggatatcccggacgggttcattgagagagatctgcggaacacccagtacatcgctaaaaaggcccttagcatgctgaatgaaatttctcaccgcgtggtcgcgacatccggaagcgtgaccgacaagctcagagaggattggcaactgatcgacgttatgaaagaactgaactgggagaagtataaagcccttggcctggtggaatactttgaggatcgggacgggagacagattggccgcatcaaggattggacgaaacggaatgaccacagacatcacgctatggatgccctcacagtcgctttcaccaaggacgtgtttatccagtatttcaacaataagaacgcctctctggatcctaacgcgaatgagcatgccattaaaaacaagtactttcagaatggacgcgctatcgcccccatgcctctccgggagttcagagctgaagccaaaaagcacctggaaaacacacttatttccatcaaagccaagaataaggttattaccggcaacatcaataaaacccgcaagaaagggggagtgaacaagaatatgcaacagacaccccggggccagctgcatctcgagacgatttacgggagcggaaaacagtatctgaccaaggaagagaaagtcaacgcttcttttgacatgagaaagatcggcacagtgagcaagtccgcgtaccgcgacgccctgcttaaacggctgtatgagaatgataacgaccccaagaaggctttcgccgggaagaatagcctcgataaacaacctatctggctggacaaggaacagatgagaaaggttccggagaaagtgaagattgtcaccctcgaagccatctacacaattcggaaagagatctctcccgatctgaaggtggacaaagtgattgatgtcggcgttcgcaagatccttatcgacagactgaacgagtatggaaatgatgctaagaaagccttttccaacctggacgaaaatcctatttggctcaacaaggagaaaggcatcagcattaagcgggtgaccatctccgggatttctaacgcgcagagcctgcacgtgaaaaaggataaggacggaaaacccatccttgacgaaaatggccgcaacatccctgtcgatttcgtgaatacggggaacaatcaccatgttgctgtgtactatagacccgtcattgacaagcggggacagctggtggttgatgaggccggcaacccgaaatacgaactcgaggaggtggtcgtgtccttctttgaagccgttacaagagctaatctggggcaacctatcattgacaaggattacaaaaccaccgagggctggcagttcctcttttctatgaagcagaacgaatatttcgtgtttcccaatgagaaaacaggattcaaccctaaggaaatcgacctgcttgatgtcgagaattacggcctgattagccccaacctgtttcgcgtgcaaaagttctccctcaaaaattatgtgtttcggcaccatctggagaccacaatcaaggacacgtctagcattcttagagggatcacctggatcgatttccgctccagcaaaggactggacacaattgtcaaggttcgggtgaaccacatcggccagattgtgtctgtcggggaatactga

SEQ ID NO: 4519 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagaactacacagagtggaataaagaaaaggggaaaaccgagcagcaagaacgcgagcataagctcgaaggaatctacagcaaacggaagagagatgaggccaagcgcgagaacctgcagtggcgggtgaacggcctgaaagaaaagctctccctggagcagcttgtcattgtgttccaggaaatgaatacacaaatcaacaatagctctgggtatctgggagctatctccgacagaagcaaagagctctactttaacaagcagaccgtgggccagtatcagatggagatgctggacaaaaatcctaacgcctctcttcgcaatatggtcttctaccggcaagattatctggacgaatttaacatgctctgggagaagcaggctgtttaccacaaggaactgaccgaggaactgaaaaaggagattagagatatcattatcttctatcagcgccggctcaaatcccaaaagggcctgattgggttttgcgagttcgaaagcagacagatcgaggtggacatcgatgggaaaaagaagattaaaacagtgggcaatcgcgtcatctctcggtccagccccctttttcaggagttcaagatttggcagatcctgaacaatattgaagtgacggttgtggggaaaaagagaaaacggcgcaagctcaaagaaaactactccgccctgttcgaggagctgaatgacgcggaacaacttgagctcaacggatctagacggctgtgtcaggaagagaaggaactgctcgcccaggagctgtttatcagagataagatgaccaaaagcgaggtccttaagctgcttttcgacaatcctcaggaactggatctgaactttaaaacaatcgacggcaacaagaccgggtacgctcttttccaagcctattccaaaatgattgagatgagcggacatgaacccgtggattttaagaagcctgttgagaaagtggtcgagtacatcaaggctgtgttcgacctcctgaattggaacacagacattctgggctttaattctaacgaggaactcgataatcagccgtattacaaactgtggcaccttctgtattccttcgaaggcgacaacacccccacggggaatggacgcctcatccagaagatgacagagctgtacggctttgaaaaagagtatgccaccattctggccaacgtcagcttccaggatgactacgggtctcttagcgctaaggcgatccataagattctccctcacctgaaagagggaaatcggtacgatgtggcctgcgtttatgctggctacagacactccgaatctagcctgacccgcgaggaaatcgccaacaaggtgctcaaagacagactgatgcttctgcccaaaaattccctccataaccctgtcgtggagaagatcctgaatcaaatggttaacgtgattaatgtcatcattgatatctatgggaagcccgacgaaattcgggtggagctggcccgcgagcttaagaaaaacgctaaggaaagagaggaactcacaaaaagcatcgcccagaccacaaaggcgcacgaggaatacaaaacgctgctgcagaccgagtttggcctcacaaacgtgtctcggaccgatatcctgcgctataagctctacaaagagctggaatcctgtggatataagacactctacagcaatacctacatttctagagagaagctgttctccaaagaatttgacatcgagcatattatcccgcaggctcggctgttcgatgacagcttctccaacaagacgcttgaggcccgctctgttaatattgaaaaaggcaacaagaccgcctatgattttgtcaaagagaagttcggggaaagcggagctgacaattccctggagcactacctcaacaatatcgaagacctgtttaagtctggcaaaatcagcaagacaaaatataacaagctcaaaatggccgagcaagatattcctgacgggttcatcgagagagatctgcggaatacccagtacattgctaagaaggccctttccatgctgaacgaaatcagccaccgcgtggtggcgacatctggatccgtcaccgacaaactcagagaggattggcagctgattgacgtgatgaaggaactgaattgggagaaatataaggcccttggcctggttgaatactttgaggatcgggacgggagacaaatcggccgcatcaaagattggacgaagcggaacgaccatagacaccatgctatggatgccctcacagtggctttcaccaaggacgtctttattcagtatttcaataacaaaaatgccagcctggatcccaacgcgaacgagcacgccatcaagaataaatactttcagaacggacgcgctattgcccctatgcccctccgggagttcagagctgaagccaagaaacatctggaaaatacacttatctctattaaggccaagaacaaagtgatcaccggcaatattaacaagacccgcaaaaagggaggagttaataaaaacatgcagcaaacaccccggggccagctgcacctcgagacgatctacgggtccggaaagcagtatctgaccaaagaagagaaggtgaatgctagctttgacatgagaaagatcggcacagtctctaaaagcgcgtaccgcgacgccctgcttaagcggctgtatgagaacgataatgaccctaaaaaggctttcgccgggaaaaactccctcgataagcagccgatttggctggacaaggaacaaatgagaaaagtgcccgagaaggttaaaatcgtgaccctcgaagccatttacacaatccggaaggagattagccctgatctgaaagtcgacaaggtgatcgatgtgggcgtccgcaagatccttattgacagactgaatgagtatggaaacgatgctaaaaaggccttttctaatctggacaaaaaccccatctggctcaataaggaaaaaggcatttccatcaagcgggttaccattagcgggatctccaacgcgcagtctctgcacgtgaagaaagataaggacggaaaacctatccttgacgagaacggccgcaatattcccgtggatttcgtcaacacggggaataaccatcacgtggctgtttactatagaccggtgatcgacaagcggggacagctggtcgtggatgaagccggcaatcctaaatacgagctcgaagaggttgtggtcagcttctttgaggccgtgacaagagctaacctggggctccccattatcgacaaggattacaaaaccaccgaaggctggcagttcctgttttccatgaagcaaaatgagtatttcgtttttcctaacgaaaagacaggattcaatcccaaagagattgaccttctggatgtggaaaactacggcctgatctctcctaatctctttcgcgtccagaagttcagcctgaaaaactatgtgtttcggcatcaccttgagaccacaattaaggacacgtcctctatcctgagagggatcacctggattgatttccgcagctccaaaggactcgacacaatcgtgaaggtccgggttaatcacattggccagatcgtgagcgtgggggagtactga

SEQ ID NO: 4520 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagaactacacagagtggaataaagaaaaggggaaaaccgagcagcaagaacgcgagcataagctcgaaggaatctacagcaaacggaagagagatgaggccaagcgcgagaacctgcagtggcgggtgaacggcctgaaagaaaagctctccctggagcagcttgtcattgtgttccaggaaatgaatacacaaatcaacaatagctctgggtatctgggagctatctccgacagaagcaaagagctctactttaacaagcagaccgtgggccagtatcagatggagatgctggacaaaaatcctaacgcctctcttcgcaatatggtcttctaccggcaagattatctggacgaatttaacatgctctgggagaagcaggctgtttaccacaaggaactgaccgaggaactgaaaaaggagattagagatatcattatcttctatcagcgccggctcaaatcccaaaagggcctgattgggttttgcgagttcgaaagcagacagatcgaggtggacatcgatgggaaaaagaagattaaaacagtgggcaatcgcgtcatctctcggtccagccccctttttcaggagttcaagatttggcagatcctgaacaatattgaagtgacggttgtggggaaaaagagaaaacggcgcaagctcaaagaaaactactccgccctgttcgaggagctgaatgacgcggaacaacttgagctcaacggatctagacggctgtgtcaggaagagaaggaactgctcgcccaggagctgtttatcagagataagatgaccaaaagcgaggtccttaagctgcttttcgacaatcctcaggaactggatctgaactttaaaacaatcgacggcaacaagaccgggtacgctcttttccaagcctattccaaaatgattgagatgagcggacatgaacccgtggattttaagaagcctgttgagaaagtggtcgagtacatcaaggctgtgttcgacctcctgaattggaacacagacattctgggctttaattctaacgaggaactcgataatcagtcctattacaaactgtggcaccttctgtatagcttcgaaggcgacaacaccccgacggggaatggacgcctcatccagaagatgacagagctgtacggctttgaaaaagagtatgccaccattctggccaacgtctctttccaggatgactacgggagcctttccgctaaggcgatccataagattctcccccacctgaaagagggaaatcggtacgatgtggcctgcgtttatgctggctacagacactctgaaagctccctgacccgcgaggaaatcgccaacaaggtgctcaaagacagactgatgcttctgcctaagaatagcctccataaccccgtcgtggagaaaatcctgaatcaaatggttaacgtgattaatgtcatcattgatatctatgggaagcctgacgaaattcgggtggagctggcccgcgagcttaagaaaaacgctaaggaaagagaggaactcacaaaatctatcgcccagaccacaaaggcgcacgaggaatacaaaacgctgctgcagaccgagtttggcctcacaaacgtgtcccggaccgatatcctgcgctataagctctacaaagagctggaaagctgtggatataagacactctactctaatacctacatttccagagagaagctgttcagcaaagaatttgacatcgagcatattatcccccaggctcggctgttcgatgactccttctctaacaagacgcttgaggcccgcagcgttaatattgaaaaaggcaacaagaccgcctatgattttgtcaaagagaagttcggggaatccggagctgacaattctctggagcactacctcaacaatatcgaagacctgtttaagagcggcaaaatctccaagacaaaatataacaagctcaaaatggccgagcaagatattccggacgggttcatcgagagagatctgcggaatacccagtacattgctaagaaggcccttagcatgctgaacgaaatctctcaccgcgtggtggcgacatccggaagcgtcaccgacaaactcagagaggattggcagctgattgacgtgatgaaggaactgaattgggagaaatataaggcccttggcctggttgaatactttgaggatcgggacgggagacaaatcggccgcatcaaagattggacgaagcggaacgaccatagacaccatgctatggatgccctcacagtggctttcaccaaggacgtctttattcagtatttcaataacaaaaatgcctctctggatcctaacgcgaacgagcacgccatcaagaataaatactttcagaacggacgcgctattgcccccatgcctctccgggagttcagagctgaagccaagaaacatctggaaaatacacttatctccattaaggccaagaacaaagtgatcaccggcaatattaacaagacccgcaaaaagggaggagttaataaaaacatgcagcaaacaccccggggccagctgcacctcgagacgatctacgggagcggaaagcagtatctgaccaaagaagagaaggtgaatgcttcttttgacatgagaaagatcggcacagtcagcaaactggcgtaccgcgacgcccttctgaagcggctctatgagaacgataatgaccccaaaaaggctttcgccgggaaaaactccctggataagcagcctatttggctcgacaaggaacaaatgagaaaagtgccggagaaggttaaaatcgtgaccctggaagccatttacacaatccggaaggagattagccccgatcttaaagtcgacaaggtgatcgatgtgggcgtccgcaagatcctgattgacagactgaatgagtatggaaacgatgctaaaaaggccttttctaatctcgacgaaaaccctatctggctgaataaagagaagggcatttccatcaaacgggttaccattagcgggatctccaacgcgcagtctcttcacgtgaagaaggataaagacggaaagcccatcctggacgaaaacggccgcaatattcctgtggatttcgtcaacacggggaataaccatcacgtggctgtttactatagacccgtgatcgacaaacggggacagctcgtcgtggatgaggccggcaatccgaagtacgaactggaggaggttgtggtcagcttctttgaagccgtgacaagagctaacctcgggcagcctattatcgacaaagattacaagaccaccgagggctggcaattcctgttttccatgaaacagaatgaatatttcgtttttcccaacgagaagacaggattcaatcctaaggaaattgaccttctggatgtggagaactacggcctgatctctcccaatctctttcgcgtccagaaattcagcctgaagaactatgtgtttcggcatcaccttgagaccacaattaaagacacgtcctctatcctgagagggatcacctggattgatttccgcagctccaagggactcgacacaatcgtgaaagtccgggttaatcacattggccaaatcgtgagcgtgggggaatactga

SEQ ID NO: 4521 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccggaaagaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagacatacaccgagtggaacaaagaaaaggggaaaacagagcagcaagaacgcgagcataagctcgaaggaatctacagcaaacggaagagagatgaggccaagcgcgagaatctgcagtggcgggtgaacggcctgaaagaaaagctctccctggagcagcttgtcattgtgttccaggaaatgaacacccaaatcaataacagctctgggtatctgggagctatctccgacagaagcaaagagctctactttaataagcagaccgtgggccagtatcagatggagatgctggacaaaaaccctaatgcctctcttcgcaacatggtcttctaccggcaagattatctggacgaatttaatatgctctgggagaagcaggctgtttaccacaaggaactgacagaggaactgaaaaaggagattagagatatcattatcttctatcagcgccggctcaaatcccaaaagggcctgattgggttttgcgagttcgaaagcagacagatcgaggtggacatcgatgggaaaaagaagattaaaacggtgggcaaccgcgtcatctctcggtccagccccctttttcaggagttcaagatttggcagatcctgaataacattgaggtgaccgttgtggggaaaaagagaaaacggcgcaagctcaaagaaaattactccgccatcttcgaggagctgaacgacgcggaacaactggagcttaatggatctagacggctctgtcaggaagagaaggaactgctggcccaggagctctttgtcagagataagatgacaaaaagcgaggtgctgaagctgctgttcgacaaccctcaggaactcgatctgaattttaaaaccatcgacggcaacaagacagggtacgctctgttccaagcctattccaaaatgattgagatgagcggacatgaacccgttgattttaagaagcctgtggagaaagtcgtggagtacatcaaggctgtcttcgaccttctcaactggaataccgacattctgggctttaactctaatgaagaactggataaccagtcctattacaaactctggcaccttctttatagcttcgaaggcgacaatacgccgacagggaacggacgcctgatccagaagatgaccgagctctacggctttgaaaaagagtatgccaccattctggccaatgtgtctttccaggatgactacgggagcctgtccgctaaggcgatccataagattcttccccacctcaaagagggaaaccggtacgatgttgcctgcgtgtatgctggctacagacactctgaaagctccctgacacgcgaggaaatcgccaataaggtcctgaaagacagactcatgctgcttcctaagaacagcctgcataatcccgtggttgagaaaatcctcaaccaaatggtgaatgtcattaacgtgatcattgatatctatgggaagcctgacgaaattcgggtggagctggcccgcgagctgaagaaaaatgctaaggaaagagaggaacttaccaaatctatcgcccagacaacgaaggcgaacgaggaatacaaaaccctcctgcagacagagtttggcctgaccaacgtttcccggacagatatcctccgctataagctgtacaaagagcttgaaagctgtggatataagaccctgtactctaatacgtacatttccagagagaaactcttcagcaaagaatttgacatcgagcacattatcccccaggctcggctgttcgatgactccttctctaacaagaccctggaggcccgcagcgtcaatattgaaaaaggcaacaagacagcctatgattttgtgaaagagaagttcggggaatccggagctgacaattctcttgagcattacctgaacaatatcgaagacctctttaagagcggcaaaatctccaagaccaaatataacaagctgaaaatggccaagcaagatattccggacgggttcatcgagagagatctccggaatacacagtacattgctaagaaagccctgagcatgcttaacgagatctctcaccgcgtggtcgcgacctccggaagcgtgacggacaagctgagagaagattggcagctcattgacgttatgaaagagctgaattgggaaaagtataaagccctgggccttgtggagtactttgaagatcgggacgggagacaaatcggccgcatcaaggattggacaaagcggaacgaccacagacatcacgctatggatgccctgaccgtcgctttcacaaaagacgtgtttattcagtatttcaataacaagaatgcctctctcgatcctaacgcgaacgagcatgccatcaaaaataagtactttcagaacggacgcgctattgcccccatgcctctgcgggagttcagagctgaagccaaaaagcacctcgagaataccctgatctccattaaggccaaaaacaaggttatcaccggcaatattaacaaaacacgcaagaaagggggagtgaataagaacatgcagcaaacgccccggggccagcttcatctggaaaccatctacgggagcggaaaacagtatctcacaaaggaggaaagagtcaatgcttcttttgacatgcgcaagatcgagaccgtgagcaaatccgcgtaccgggacgccctgctgaagagactttatgagaacgataatgaccccaaaaaggctttcgccggcaaaaacagcctggataagcagcctatttggctcgacaaggaacaaaaacggaaggttccggagaaagtgaagatcgtcacactggaagccatttacaccatccgcaaagagatttctcccgatctcaaggtggacaaggtgatcgatgtcggggttagaaaaatcctgattgaccggcttaatgagtatggcaacgatgctaagaaagccttttccaatctggacgaaaaccctatctggctgaataaggagaaaggaattagcatcaagcgcgtgacgatttccggcatctctaacgcgcagagcctccacgtgaagaaagataaggacgggaaacccatcctggacgaaaacggaagaaatattcctgtcgatttcgtgaacacaggcaataaccaccatgttgctgtgtactatcggcccgtcatcgacaagagagggcagcttgtggttgatgaggccggaaatccgaaatacgaactggaggaggtggtcgtgtccttctttgaagccgttacccgcgctaacctcggccagcctattatcgacaaggattacaaaaccacagaggggtggcaattcctgttttctatgaagcagaatgaatatttcgtgtttcccaacgagaagaccggcttcaatcctaaagaaattgacctcctggatgtcgagaactacggacttatcagccccaatctgtttcgggtgcagaagttctccctgaaaaactatgtgtttagacaccatctcgagacaacgattaaggacacctctagcatcctgcgcggcatcacatggattgatttccggtccagcaaagggcttgacaccatcgtcaaggttagagtgaatcacattggacaaatcgtgtctgtcggcgaatactga

SEQ ID NO: 4522 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagacatacaccgagtggaacaaagaaaaggggaaaacagagcagcaagaaaaggagcataaactcgaaggaatctacagcaagcgcaagcgggatgaggccaaaagagagaatctgcagtggcgcgtgaacggcctgaaggaaaaactctccctggagcagcttgtcattgtgttccaggaaatgaacacccaaatcaataacagctctgggtatctgggagctatctccgaccggagcaaggagctctactttaataaacagaccgtgggccagtatcagatggagatgctggacaagaaccctaatgcctctcttagaaacatggtcttctaccgccaagattatctggacgaatttaatatgctctgggagaagcaggctgtttaccacaaagaactgacagaggaactgaagaaagagattcgggatatcattatcttctatcagagacgcctcaagtcccaaaaaggcctgattgggttttgcgagttcgaaagccggcagatcgaggtggacatcgatggaaagaagaaaattaagacggtgggcaacagagtcatctctcgctccagccccctttttcaggagttcaaaatttggcagatcctgaataacattgaagtgaccgttgtggggaagaaacggaagagacggaaactcaaggaaaattactccgccctgttcgaggagctgaacgacgcggaacaacttgagctcaatggatctcgcagactgtgtcaggaagagaaggaactgctcgcccaggagctgtttatccgggataaaatgacaaagagcgaggtccttaaactcctgttcgacaaccctcaggaactggatctgaattttaagaccatcgacggcaacaaaacagggtacgctcttttccaagcctattccaagatgattgagatgagcggacatgaacccgtggattttaagaaacctgttgagaaggtggtcgagtacatcaaagctgtgttcgacctcctgaactggaataccgacattctgggctttaactctaatgaggaactcgataaccagtcctattacaagctgtggcaccttctgtatagcttcgaaggcgacaatacgccgacagggaacggaagactcatccagaaaatgaccgagctgtacggctttgaaaaggagtatgccaccattctggccaatgtctctttccaggatgactacgggagcctttccgctaaggcgatccataaaattctcccccacctgaaggagggaaaccgctacgatgtggcctgcgtttatgctggctaccggcactctgaaagctccctgacaagagaggaaatcgccaataaagtgctcaaggaccgcctgatgcttctgcctaaaaacagcctccataatcccgtcgtggagaagatcctgaaccaaatggttaatgtgattaacgtcatcattgatatctatgggaagcctgacgaaattagagtggagctggcccgggagcttaaaaagaatgctaaagaacgcgaggaactcaccaagtctatcgcccagacaacgaaagcgcacgaggaatacaagaccctgctgcagacagagtttggcctcaccaacgtgtccagaacagatatcctgcggtataaactttacaaggagctggaaagctgtggatataagaccctctactctaacacgtacatttcccgcgagaaactgttcagcaaggaatttgacatcgagcatattatcccccaggctagactgttcgatgactccttctctaataaaacccttgaggcccggagcgttaacattgaaaagggcaataaaacagcctatgattttgtcaaggagaagttcggggaatccggagctgacaactctctggagcactacctcaataacatcgaagacctgtttaaaagcggcaagatctccaaaaccaagtataataaactcaagatggccgagcaagatattccggacgggttcatcgagcgcgatctgagaaacacacagtacattgctaagaaagcccttagcatgctgaatgaaatctctcaccgggtggtggcgacctccggaagcgtcacggacaagctccgcgaggattggcagctgattgacgtgatgaaagaactgaactgggagaagtataaagcccttggcctggttgaatactttgaggatagagacgggcggcaaatcggcagaatcaaggattggacaaagcgcaatgaccatcggcaccatgctatggatgccctcaccgtggctttcacaaaagacgtctttattcagtatttcaacaataagaacgcctctctggatcctaatgcgaacgagcacgccatcaaaaacaagtactttcagaatggcagagctattgcccccatgcctctccgcgagttccgggctgaagccaaaaagcatctggaaaacacccttatctccattaaggccaaaaataaggtgatcaccggaaacattaataaaacaagaaagaaagggggagttaacaagaatatgcagcaaacgccccgcggccagctgcacctcgagaccatctacgggagcggaaaacagtatctgacaaaggaagagaaggtgaacgcttcttttgacatgcggaaaatcggcaccgtcagcaagctggcgtacagagacgcccttctgaaacgcctctatgagaatgataacgaccccaagaaggctttcgccgggaaaaattccctggataagcagcctatttggctcgacaaagaacaaatgcggaaggtgccggagaaagttaagatcgtgacactggaagccatttacaccatcagaaaagagattagccccgatcttaaggtcgacaaggtgatcgatgtgggcgtccggaaaatcctgattgaccgcctgaacgagtatggaaatgatgctaagaaagccttttctaacctcgacgaaaatcctatctggctgaacaaggagaaaggcatttccatcaagagagttacgattagcgggatctccaatgcgcagtctcttcacgtgaagaaagataaggacggaaaacccatcctggacgaaaacggccggaacattcctgtggatttcgtcaatacagggaacaatcatcacgtggctgtttactatcgccccgtgatcgacaagagaggacagctcgtcgtggatgaggccggcaacccgaaatacgaactggaggaggttgtggtcagcttctttgaagccgtgacccgggctaatctcgggcagcctattatcgacaaggattacaaaaccacagagggctggcaattcctgttttccatgaagcagaacgaatatttcgtttttcccaatgagaagaccggattcaaccctaaagaaattgaccttctggatgtggagaattacggcctgatctctcccaacctctttagagtccagaagttcagcctgaaaaattatgtgtttcgccatcaccttgagacaacgattaaggacacctcctctatcctgcgggggatcacatggattgatttcagaagctccaaaggactcgacaccatcgtgaaggtccgcgttaaccacattggccaaatcgtgagcgtgggggaatactga

SEQ ID NO: 4523 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagaactacacagagtggaataaagaaaaggggaaaaccgagcagcaagaacgcgagcataagctcgaaggaatctacagcaaacggaagagagatgaggccaagcgcgagaacctgcagtggcgggtgaacggcctgaaagaaaagctctccctggagcagcttgtcattgtgttccaggaaatgaatacacaaatcaacaatagctctgggtatctgggagctatctccgacagaagcaaagagctctactttaacaagcagaccgtgggccagtatcagatggagatgctggacaaaaatcctaacgcctctcttcgcaatatggtcttctaccggcaagattatctggacgaatttaacatgctctgggagaagcaggctgtttaccacaaggaactgaccgaggaactgaaaaaggagattagagatatcattatcttctatcagcgccggctcaaatcccaaaagggcctgattgggttttgcgagttcgaaagcagacagatcgaggtggacatcgatgggaaaaagaagattaaaacagtgggcaatcgcgtcatctctcggtccagccccctttttcaggagttcaagatttggcagatcctgaacaatattgaagtgacggttgtggggaaaaagagaaaacggcgcaagctcaaagaaaactactccgccctgttcgaggagctgaatgacgcggaacaacttgagctcaacggatctagacggctgtgtcaggaagagaaggaactgctcgcccaggagctgtttatcagagataagatgaccaaaagcgaggtccttaagctgcttttcgacaatcctcaggaactggatctgaactttaaaacaatcgacggcaacaagaccgggtacgctcttttccaagcctattccaaaatgattgagatgagcggacatgaacccgtggattttaagaagcctgttgagaaagtggtcgagtacatcaaggctgtgttcgacctcctgaattggaacacagacattctgggctttaattctaacgaggaactcgataatcagccgtattacaaactgtggcaccttctgtattccttcgaaggcgacaacacccccacggggaatggacgcctcatccagaagatgacagagctgtacggctttgaaaaagagtatgccaccattctggccaacgtcagcttccaggatgactacgggtctcttagcgctaaggcgatccataagattctccctcacctgaaagagggaaatcggtacgatgtggcctgcgtttatgctggctacagacactccgaatctagcctgacccgcgaggaaatcgccaacaaggtgctcaaagacagactgatgcttctgcccaaaaattccctccataaccctgtcgtggagaagatcctgaatcaaatggttaacgtgattaatgtcatcattgatatctatgggaagcccgacgaaattcgggtggagctggcccgcgagcttaagaaaaacgctaaggaaagagaggaactcacaaaaagcatcgcccagaccacaaaggcgcacgaggaatacaaaacgctgctgcagaccgagtttggcctcacaaacgtgtctcggaccgatatcctgcgctataagctctacaaagagctggaatcctgtggatataagacactctacagcaatacctacatttctagagagaagctgttctccaaagaatttgacatcgagcatattatcccgcaggctcggctgttcgatgacagcttctccaacaagacgcttgaggcccgctctgttaatattgaaaaaggcaacaagaccgcctatgattttgtcaaagagaagttcggggaaagcggagctgacaattccctggagcactacctcaacaatatcgaagacctgtttaagtctggcaaaatcagcaagacaaaatataacaagctcaaaatggccgagcaagatattcctgacgggttcatcgagagagatctgcggaatacccagtacattgctaagaaggccctttccatgctgaacgaaatcagccaccgcgtggtggcgacatctggatccgtcaccgacaaactcagagaggattggcagctgattgacgtgatgaaggaactgaattgggagaaatataaggcccttggcctggttgaatactttgaggatcgggacgggagacaaatcggccgcatcaaagattggacgaagcggaacgaccatagacaccatgctatggatgccctcacagtggctttcaccaaggacgtctttattcagtatttcaataacaaaaatgccagcctggatcccaacgcgaacgagcacgccatcaagaataaatactttcagaacggacgcgctattgcccctatgcccctccgggagttcagagctgaagccaagaaacatctggaaaatacacttatctctattaaggccaagaacaaagtgatcaccggcaatattaacaagacccgcaaaaagggaggagttaataaaaacatgcagcaaacaccccggggccagctgcacctcgagacgatctacgggtccggaaagcagtatctgaccaaagaagagaaggtgaatgctagctttgacatgagaaagatcggcacagtctctaaaagcgcgtaccgcgacgccctgcttaagcggctgtatgagaacgataatgaccctaaaaaggctttcgccgggaaaaactccctcgataagcagccgatttggctggacaaggaacaaatgagaaaagtgcccgagaaggttaaaatcgtgaccctcgaagccatttacacaatccggaaggagattagctctgatctgaaagtcgacaaggtgatcgatgtgggcgtccgcaagatccttattgacagactgaatgagtatggaaacgatgctaaaaaggccttttccaatctggacaaaaaccctatctggctcaataaggaaaaaggcattagcatcaagcgggttaccatttccgggatctctaacgcgcagagcctgcacgtgaagaaagataaggacggaaaacccatccttgacgagaacggccgcaatattcctgtggatttcgtcaacacggggaataaccatcacgtggctgtttactatagacccgtgatcgacaagcggggacagctggtcgtggatgaagccggcaatccgaaatacgagctcgaagaggttgtggtctccttctttgaggccgtgacaagagctaacctggggctccctattatcgacaaggattacaaaaccaccgaaggctggcagttcctgttttctatgaagcaaaatgagtatttcgtttttcccaacgaaaagacaggattcaatcctaaagagattgaccttctggatgtggaaaactacggcctgatcagccccaatctctttcgcgtccagaagttctccctgaaaaactatgtgtttcggcatcaccttgagaccacaattaaggacacgtctagcatcctgagagggatcacctggattgatttccgctccagcaaaggactcgacacaatcgtgaaggtccgggttaatcacattggccagatcgtgtctgtgggggagtactga

SEQ ID NO: 4524 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagaactacacagagtggaataaagaaaaggggaaaaccgagcagcaagaacgcgagcataagctcgaaggaatctacagcaaacggaagagagatgaggccaagcgcgagaacctgcagtggcgggtgaacggcctgaaagaaaagctctccctggagcagcttgtcattgtgttccaggaaatgaatacacaaatcaacaatagctctgggtatctgggagctatctccgacagaagcaaagagctctactttaacaagcagaccgtgggccagtgccagatggagatgctggacaaaaatcctaacgcctctcttcgcaatatggtcttctatcggcaagattacctggacgaatttaacatgctctgggagaagcaggctgtttatcacaaggaactgaccgaggaactgaaaaaggagattagagatatcattatcttctaccagcgccggctcaaatcccaaaagggcctgattgggttttgtgagttcgaaagcagacagatcgaggtggacatcgatgggaaaaagaagattaaaacagtgggcaatcgcgtcatctctcggtccagccccctttttcaggagttcaagatttggcagatcctgaacaatattgaagtgacggttgtggggaaaaagagaaaacggcgcaagctcaaagaaaactattccgccctgttcgaggagctgaatgacgcggaacaacttgagctcaacggatctagacggctgtgccaggaagagaaggaactgctcgcccaggagctgtttatcagagataagatgaccaaaagcgaggtccttaagctgcttttcgacaatcctcaggaactggatctgaactttaaaacaatcgacggcaacaagaccgggtacgctcttttccaagcctactccaaaatgattgagatgagcggacatgaacccgtggattttaagaagcctgttgagaaagtggtcgagtatatcaaggctgtgttcgacctcctgaattggaacacagacattctgggctttaattctaacgaggaactcgataatcagccgtactataaactgtggcaccttctgtactccttcgaaggcgacaacacccccacggggaatggacgcctcatccagaagatgacagagctgtatggctttgaaaaagagtacgccaccattctggccaacgtcagcttccaggatgactatgggtctcttagcgctaaggcgatccataagattctccctcacctgaaagagggaaatcggtacgatgtggcctgtgtttacgctggctatagacactccgaatctagcctgacccgcgaggaaatcgccaacaaggtgctcaaagacagactgatgcttctgcccaaaaattccctccataaccctgtcgtggagaagatcctgaatcaaatggttaacgtgattaatgtcatcattgatatctacgggaagcccgacgaaattcgggtggagctggcccgcgagcttaagaaaaacgctaaggaaagagaggaactcacaaaaagcatcgcccagaccacaaaggcgcacgaggaatataaaacgctgctgcagaccgagtttggcctcacaaacgtgtctcggaccgatatcctgcgctacaagctctataaagagctggaatcctgcggatacaagacactctatagcaatacctacatttctagagagaagctgttctccaaagaatttgacatcgagcatattatcccgcaggctcggctgttcgatgacagcttctccaacaagacgcttgaggcccgctctgttaatattgaaaaaggcaacaagaccgcctacgattttgtcaaagagaagttcggggaaagcggagctgacaattccctggagcactatctcaacaatatcgaagacctgtttaagtctggcaaaatcagcaagacaaaatacaacaagctcaaaatggccgagcaagatattcctgacgggttcatcgagagagatctgcggaatacccagtatattgctaagaaggccctttccatgctgaacgaaatcagccaccgcgtggtggcgacatctggatccgtcaccgacaaactcagagaggattggcagctgattgacgtgatgaaggaactgaattgggagaaatacaaggcccttggcctggttgaatattttgaggatcgggacgggagacaaatcggccgcatcaaagattggacgaagcggaacgaccatagacaccatgctatggatgccctcacagtggctttcaccaaggacgtctttattcagtacttcaataacaaaaatgccagcctggatcccaacgcgaacgagcacgccatcaagaataaatattttcagaacggacgcgctattgcccctatgcccctccgggagttcagagctgaagccaagaaacatctggaaaatacacttatctctattaaggccaagaacaaagtgatcaccggcaatattaacaagacccgcaaaaagggaggagttaataaaaacatgcagcaaacaccccggggccagctgcacctcgagacgatctacgggtccggaaagcagtacctgaccaaagaagagaaggtgaatgctagctttgacatgagaaagatcggcacagtctctaaaagcgcgtatcgcgacgccctgcttaagcggctgtacgagaacgataatgaccctaaaaaggctttcgccgggaaaaactccctcgataagcagccgatttggctggacaaggaacaaatgagaaaagtgcccgagaaggttaaaatcgtgaccctcgaagccatttatacaatccggaaggagattagccctgatctgaaagtcgacaaggtgatcgatgtgggcgtccgcaagatccttattgacagactgaatgagtacggaaacgatgctaaaaaggccttttctaatctggacaaaaaccccatctggctcaataaggaaaaaggcatttccatcaagcgggttaccattagcgggatctccaacgcgcagtctctgcacgtgaagaaagataaggacggaaaacctatccttgacgagaacggccgcaatattcccgtggatttcgtcaacacggggaataaccatcacgtggctgtttattacagaccggtgatcgacaagcggggacagctggtcgtggatgaagccggcaatcctaaatatgagctcgaagaggttgtggtcagcttctttgaggccgtgacaagagctaacctggggctccccattatcgacaaggattacaaaaccaccgaaggctggcagttcctgttttccatgaagcaaaatgagtacttcgtttttcctaacgaaaagacaggattcaatcccaaagagattgaccttctggatgtggaaaactatggcctgatctctcctaatctctttcgcgtccagaagttcagcctgaaaaactacgtgtttcggcatcaccttgagaccacaattaaggacacgtcctctatcctgagagggatcacctggattgatttccgcagctccaaaggactcgacacaatcgtgaaggtccgggttaatcacattggccagatcgtgagcgtgggggagtattga

SEQ ID NO: 4525 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtgaatgaggctgaaaacaaagatgagcggtcctctatcgtcaagctgggcgttcgcgtgaatcccctcacagtggacgaactgacgaacttcgagaaaggaaagagcattaccacaaatgccgatagaacccttaaacggggaatgcgcagaaacctgcagcggtacaagctccgcagagaaacactgaccgaggtcctgaaggagcacaaactcatcacagaagacaccattctgtccgagaatggcaaccggacgacctttgaaacatatcgccttagagcgaaggctgtgaccgaggagatctctctggaagagttcgcccgggttctcctgatgatcaataaaaagcgcgggtacaaaagctccagaaaggccaagggagtggaagagggcacacttattgatggcatggacatcgctcgggaactgtataacaataacctcacccctggggagctgtgcctgcaactcctggatgccgggaaaaagtttcttccggacttctaccgctctgatctgcagaatgagctcgacagaatttgggaaaaacagaaggagtattaccccgaaatcctgacggatgtccttaaagaggaactgcggggcaagaaaagagacgctgtgtgggccatttgtgcgaagtattttgtttggaaggagacatacaccgagtggaacaaagaaaaggggaaaacagagcagcaagaacgcgagcataagctcgaaggaatctacagcaaacggaagagagatgaggccaagcgcgagaatctgcagtggcgggtgaacggcctgaaagaaaagctctccctggagcagcttgtcattgtgttccaggaaatgaacacccaaatcaataacagctctgggtatctgggagctatctccgacagaagcaaagagctctactttaataagcagaccgtgggccagtatcagatggagatgctggacaaaaaccctaatgcctctcttcgcaacatggtcttctaccggcaagattatctggacgaatttaatatgctctgggagaagcaggctgtttaccacaaggaactgacagaggaactgaaaaaggagattagagatatcattatcttctatcagcgccggctcaaatcccaaaagggcctgattgggttttgcgagttcgaaagcagacagatcgaggtggacatcgatgggaaaaagaagattaaaacggtgggcaaccgcgtcatctctcggtccagccccctttttcaggagttcaagatttggcagatcctgaataacattgaggtgaccgttgtggggaaaaagagaaaacggcgcaagctcaaagaaaattactccgccatcttcgaggagctgaacgacgcggaacaactggagcttaatggatctagacggctctgtcaggaagagaaggaactgctggcccaggagctctttgtcagagataagatgacaaaaagcgaggtgctgaagctgctgttcgacaaccctcaggaactcgatctgaattttaaaaccatcgacggcaacaagacagggtacgctctgttccaagcctattccaaaatgattgagatgagcggacatgaacccgttgattttaagaagcctgtggagaaagtcgtggagtacatcaaggctgtcttcgaccttctcaactggaataccgacattctgggctttaactctaatgaagaactggataaccagtcctattacaaactctggcaccttctttatagcttcgaaggcgacaatacgccgacagggaacggacgcctgatccagaagatgaccgagctctacggctttgaaaaagagtatgccaccattctggccaatgtgtctttccaggatgactacgggagcctgtccgctaaggcgatccataagattcttccccacctcaaagagggaaaccggtacgatgttgcctgcgtgtatgctggctacagacactctgaaagctccctgacacgcgaggaaatcgccaataaggtcctgaaagacagactcatgctgcttcctaagaacagcctgcataatcccgtggttgagaaaatcctcaaccaaatggtgaatgtcattaacgtgatcattgatatctatgggaagcctgacgaaattcgggtggagctggcccgcgagctgaagaaaaatgctaaggaaagagaggaacttaccaaatctatcgcccagacaacgaaggcgaacgaggaatacaaaaccctcctgcagacagagtttggcctgaccaacgtttcccggacagatatcctccgctataagctgtacaaagagcttgaaagctgtggatataagaccctgtactctaatacgtacatttccagagagaaactcttcagcaaggaatttgacatcgagcacattatcccccaggctcggctgttcgatgactccttctctaacaagaccctggaggcccgcagcgtcaatattgaaaaaggcaacaagacagcctatgattttgtgaaagagaagttcggggaatccggagctgacaattctcttgagcattacctgaacaatatcgaagacctctttaagagcggcaaaatctccaagaccaaatataacaagctgaaaatggccgagcaagatattccggacgggttcatcgagagagatctccggaatacacagtacattgctaagaaggccctgagcatgcttaacgaaatctctcaccgcgtggtcgcgacctccggaagcgtgacggacaaactgagagaggattggcagctcattgacgttatgaaggaactgaattgggagaaatataaggccctgggccttgtggaatactttgaggatcgggacgggagacaaatcggccgcatcaaagattggacaaagcggaacgaccacagacatcacgctatggatgccctgaccgtcgctttcacaaaggacgtgtttattcagtatttcaataacaaaaatgcctctctcgatcctaacgcgaacgagcatgccatcaagaataaatactttcagaacggacgcgctattgcccccatgcctctgcgggagttcagagctgaagccaagaaacacctcgaaaataccctgatctccattaaggccaagaacaaagttatcaccggcaatattaacaagacacgcaaaaagggaggagtgaataaaaacatgcagcaaacgccccggggccagcttcatctggagaccatctacgggagcggaaagcagtatctcacaaaagaagagaaggtcaatgcttcttttgacatgagaaagatcgagaccgtgagcaaatccgcgtaccgcgacgccctgctgaagcggctttatgaaaacgataatgaccccaaaaaggctttcgccggcaaaaacagcctggataagcagcctatttggctcgacaaggagcaaatgagaaaagttccggaaaaggtgaaaatcgtcacactggaggccatttacaccatccggaaggagatttctcccgatctcaaagtggacaaggtgatcgatgtcggggttcgcaagatcctgattgacagacttaatgaatatggcaacgatgctaaaaaggccttttccaatctggacaaaaaccctatctggctgaataaggagaaaggaattagcatcaagcgggtgacgatttccggcatctctaacgcgcagagcctccacgtgaagaaagataaggacgggaaacccatcctggacgaaaacggacgcaatattcctgtcgatttcgtgaacacaggcaataaccaccatgttgctgtgtactatagacccgtcatcgacaagcgggggcagcttgtggttgatgaggccggaaatccgaaatacgaactggaggaggtggtcgtgtccttctttgaagccgttaccagagctaacctcggcctgcctattatcgacaaggattacaaaaccacagaggggtggcagttcctcttttctatgaagcaaaatgaatatttcgtgtttcccaacgagaagattggcttcaatcctaaagaaatcgacctgcttgatgtcgagaactacggactgattagccccaatctgtttcgcgtgcagaagttctccctcaaaaactatgtgtttcggcaccatctggagaccacaatcaaggacacgtctagcatccttagaggcattacctggatcgatttccgctccagcaaagggctggacacaattgtcaaggttcgggtgaatcacatcggacagattgtgtctgtcggcgaatactga

SEQ ID NO: 4526 - RNA, 4311 nt, synthetic construct
  misc_feature 1..4311: note = Cas9 variant
  source 1..4311: mol_type = other RNA
atgaagagaatcctgggcctcgacctggggaccaacagcattggatgggcccttgtggatgaggctgaaaataaagacgagcggtcctctatcgtcaagctgggcgttcgcgtgaaccccctcacagtggatgaactgacgaatttcgagaaaggaaagagcattaccacaaacgccgacagaacccttaaacggggaatgcgcagaaatctgcagcggtacaagctccgcagagaaacactgatggaggtcctgaaggagcacaaactcatcaccgaagatacaattctgtccgagaacggcaatcggaccacgtttgaaacctatcgccttagagcgaaggctgccacagagaaaatctctctggaggagttcgcccgggtgctcctgatgatcaacaagaaacgcgggtacaagagctgcagaaaggctaaaggagccgaagaaggcacccttattgacggcatggatatcgctcgggagctgtataataacaatctcacacctggggaactgtgtctgcaactcctggacgccggaaagaaataccttccggatttttatcgctccgacctgcagaacgagctcgatagaatttgggagaagcagaaagaatactatcccgagatcctgaccgaagttcttaaggaggaactgcggggcaaaaagagagacgcggtgtgggccatttgcgctaagtctttcgtctgggaggagtactacacggaatggaataaagagaaggggaaaacagaacagcaagagcgcgaacataagctcgagggaatctatagcaaacggaagagagatgaggccaagcgcgaaaacctgcagtggcgggtgaatggcctgaaagagaagctctccctggaacagcttgttattgtgctgcaggagatgaacatccaaatcaacaatagctctgggtacctcggagctatttccgacagaagcaaagagctgtattttaacaagcagaccgtcggccagtaccagatggaaatgcttgacaaaaatcctaacgcctctctgcgcaatatggtgttctatcggcaagattacctcgacgagtttaacacactgtgggaaaagcaggcggagtatcacaaggaactgaccggcgagctcaaaaaggagatcagagatattgtgatcttctaccagcgccggctgaaatcccaaaaggggcttgtcggattttgtgagttcgaaagcagacagattgaagttgagatcgacggcaaaaagaagatcaaaaccgtggggaatcgcgtgattccccggtcttcccctctgtttcaggagttcaagatctggcagattctcaacaatatcgaagtcacagtggttgggaaaaagggcaaaagacggaagcaaaaagataacagccccacgctgtttgacgggctggatgacaccgagcagcttgaactcaatggatcccgctacctgtatcaggaggaaaaggagctgctcgcccaggaactgttcgtgagagataagatgacaaaatctgacgtccttaagctcctgttcgataaccctcaagagctggacctgaattttaaaaccattgacggcaacaagacaggctacacccttttccaggcttatagcaaaatgatcgagatgtccgggcatgaaccggtggattttaagaagacggttgagaaagtggtcgaacacgtgaaggccgtcttcgacctcctgaattggaacacagatatcctgggatttaacagcaatgaggagctcgacaaccagtcttactataaactgtggcatcttctgtactccttcgaaggcgataatacccccaccgggaacgctcggctcgtgcagaagattacagagctgtatggatttgaaaaagagtacgccatcattctggccaatgttaccttccaagacgattacggcagcctttctgctaaggcgatccacaagattctccctcacctgaaagaagggaacagatatgacgtggcctgcgcttacgccggctataagcatagcgagtcctctctgacaaaagaggaaatcgccaataaggctctcaaagatcgcctgacgcttctgcccaagaacaatctccggaaccctgtcgtggagaagattctgaatcagatggttaacgtgatcaatgccatcattgacacctacggaaaacccgatgaaatcagagtcgagctggcgcgcgaacttaagaaaaacgctaaggagagagaggaactcacaaaatttattgccgagaccacacggaagcacgaagagttcaaaatcctgctgcagagcgaatttggcctcaccaatgtgtcccgcacggacattctgagatataaactttacaaggagctggagagctgtgggtataaaaccctctactctaacacatacatcccgcgggaaaagctgttctccaaagagtttgatatcgaacatattatccctcaggcccgcctgttcgacgacagcttctctaacaagacccttgaggctagatccattaatctggagaaaggaaacaagacagcctatgattttgtgaaggaaaaattcggcgagagcggggctgacaattccctcgatcactacctgaacaatatcgaagacctctttaagtctggaaaaattagcaagaccaaatataacaagctgaagatggccgagcaagatatccccgacggcttcatcaatcgggatcttcgcaacacgcagtacattgcgaaaaaggccctgtccatgctcaatgaaatctctagacgggttgtcgctacaagcgggaccattacagacaaactgcgccaggattggcaactggtggacgtgatgaaggagcttaactgggagaaatataaggccctgggcctcgtcgaatactttgaggataaggacggaagacagatcggccggattaaagattggaccaagagaaatgaccaccgccatcacgctatggacgccctgaccgtggcgttcacaaaagatatctttatccagtatttcaacaataagaacgcctccctcaatagcaacacgaacgaatacgctattaaaaataagtactttcagaacgggcgggccatcgctcctattcccctgagagagttccgcgttgaagccaagaaacatcttgagaataccctgatctctattaaggccaaaaacaaggtggtcacaggaaatatcaacaaaaccaagaaacggggcggggtgaataagtatctccaacagacacccagaggacagctgcacctggagaccatttacggctccgggaagcagtatcttacgaaagaagagaaggttaacgctagctttgacatgaaaaagatcgcgacagtgtctaaatccgcctaccgcgatgtcctgctcaagcggctgcatgaaaatgacaacgatcctaagaaggctttcaccggcaagaatagcctcgacaaacaaccgatctggctggataaggagcagaccagaaaagtgcccgaaaaggttaagacagtgacccttgagacaatttatacggtccgcaaagagatctctcctgacctgaaggtggataaagtgattgacgccggagtccggaagatcctgaccggcagactcaacgaatacgggaatgatgccaaaaaggcttttagcaacctggacgagaatcccatttggcttaacaaggaaaaaggaatctccatcaagcgggttacaattagcggcatctctaatgcccagtccctgcacgtgaaaaaggacaaagatgggaagcctattctcgacgaggatagccgcaacatccccgtggacttcgtcaacaccggaaataaccaccatgtggcggtttatagacggccggtgattgataaacgcggccagctggtcatcgacgaggctgggaatcctaagtacgaactcgaggaagtggttgtgtccttctttgaggccgtcacaagagccaacctgggccaacccatcattgataaggactacaaaacctctgaaggatggcagttcctttttagcatgaagcagaatgagtatttcgtgtttcctaacgagaaaacgggcttcaatcccaaggaaatcgatctgctggacgctgagaactacggggttatttcccctaatctctttcgggtgcaaaaattcgcccacaagaactatgtctttagacatcacctggaaaccacaatcaaggatacctctagcattcttaaaggaatcacatggattgacttccgctcctctaagggcctggatgcgatcgtgaaagtgcgggtcaatcacatcgggcagattgttagcgtgggagagtactga

SEQ ID NO: 4527 - RNA, 4311 nt, synthetic construct
  misc_feature 1..4311: note = Cas9 variant
  source 1..4311: mol_type = other RNA
atgaagtacatcaaatatattctgggcctcgacatcgggagcaactccattggatgggccctgatccagcttgatctgctccaaaagaccaaaagaattatcgctgccggctctcggatcattcccatggaccagaaggtgctgagcgatttcgggaaaggaatcacaatttcccctacggcgcagcgcacctcttacagaaatgctcggcactgccgcgagagacatcttctgcggcgcgaaagactccaccgggtcctgcatatcctgggctttctcccgacacactatgacaagcagattgatttcagcaagcgctacgggaaatttgttgacaacaccgagcccaagatcgcctataatgaaggaaaattcctgtttatggattccttccaagagatgctttctgactttaagagccatcagcctgatctgttctacacaaagaagaacggcgaagagtccaagattccctatgactggaccatctactacctcagaaagaaggccctgagccagaaaatctctaaggaggaacttgcttggattatcctgaattttaaccagaaacggggctattaccaactccgcgaggaagaggggaataaggagaacgatttcgaaattatctccagcaaaattatctctgtgatcaagaaggacaaagataagaaatataataagtactggtatgacattatcctggagaacggactggtgtaccaggccgctttttataatgacttcgtctacaactggattaatcaggatagagaatttatcattgagcggacatccctcaaaaacggcgccgaaaaggtgaagctgagctaccttcctaccttcgacgagatcgataaaatggacaagaaagagcaggataagtattacaaaaagatcaagattaaaacggaaaattctatcgggaacaagaccgttggatgttatatttacgaccacatcctgcaaaaccccaatgagaaaattaagggcaaactcgtgcgcacaatcgaaagaaagtattacaaggaggaactgaaagcgattcttgagaagcagatcgccctgcagcctgaactcttcaccgatcaactgctggctgactgcatccgggaactctattccaaaaacgaggcccagcagagaaatctggctgcccgcgattttgtccaccttctggtggaagacattatcttctaccagcggccgctcagacgccaaaagagcacactggcgaactgttcccttgagtctcggagctacattgataaagactcccataccagaaaggaagctcccctgaaagtttgccctaagagcaatccctattaccaggagtttcgcgtgctccagtggctgcagaacctgaagatctatgagattgactctgatcaagaagtcacgcaccagttcatcaaaacactcgaggacaagcagcagctgtttgagttccttatggcccaaaaagagatcgattgtgaggaactgctcaagtactttctgaatcagacctatcctaacgccaaagagaaggctctgaagtccgaacttaaaaagtggaaagacacataccggtggaattatgtgtacgatattggggaaaagagctctaaaaagtaccccatgaacgaaaccagatatgagctcaagcgccatctggagaaagtggccaatctgccggacgatttcctcagctccgaagtcgagtacctgctttggcacctgatctattctgttaaggacaaagtggcctacgaaaagggactcaaaaagtttgctcagaagcaccatctggataaagacagcttcgtggagtcctttaagaaattcaacccttatcccagcgaatacggctctttttccgagaaggcgattcggaaactgcttcctctcatgagattcggcgcccactgggatttcaatcatatcgacaagaacacccagaaacgcattgaggatctgatcacaggggtcgaaaatgaggaaatccggacgattctgagagagaaggctgaaaagtatcaactcgagaaagagaccgactttcaggacctgcccctttggctggcccagtacatcgtgtacaaccggcacgccgaagctagctctctcgagaagtggacatccgttaacgatctggaaacctatctgaatgagttcaaacaacatagccttcgcaaccccattgtggagcaggtcgtgatggaaacactcagagttgtgcgggacatctggcagcagtacggacaaggccaggcctcctttttcaatgagattcacatcgaactggggagagagctgaagaaaaccgcgaaggaacgcgagaagctctctaaacagaaccagaagaatgaggatatcaacctgagcattaaagaaaaacttaaagagctggaaaagtataatacgcgggcttactccatcacacaccaagagaagtataaactctggctggaacagaagcatatttctccttacaccggacagatcattagcccggagaacctgtttaccgacaattatgagatcgaacacattatcccccagtccagattctttgatgacagcctttctaacaaagtcgtgtgcgagtccatcgtcaataaggccccttacaaagatcgccaactcggcctggagttcattaagaaccagggaggaagaatcgtgaaggagctgagcaaagaaaataagacaattaaaatctttaccgaggagcagtaccggacattcattaaggaacattattctaacaatcccgagaaaacgaagaagctcctgcttgaagagatccctgagaaaatggttgcccgccaaatgaacgacacctgttacatctccaagtttattagcgaaatcctgtctaaaattgtgagaagcgatgagcaggacgaaggcgtccactccaagaacgtgatcctctgcacaggcaaaattaccagcatcctgcggcaggattgggggctgaatgacatctgggataaccttattctgccccgcttcgagagaatgaataacctcctgcagaaggaaaaatttacaatctattctattgagaagcaaaagaaaatcccggttgtgcctattaatgaccagttcaagtccttccagaaaaagcggatcgaccaccgccatcacgctatggatgccattatcatcgcttgtaccacgagagagcatattaactacatcaataaccagcacgccctcgaaaaagagaaggacaagaaagaaaagcaagaggaacgggataaactgcgcgagaaactttgcattaaaaagtataataacagaagcgagggaaattactcctggatctttaagaaaccctgggacaccttcacacaggaagtccgggtggcgctggaggatattgtggtttcttttaagcagaacctcagagtcatcaataaagccaccaactattacgaacgctgggtggaggaaaatggcaagtacatcaaaaagatggtgaagcaggaggggacaaactgggctattcggaaacctctgcatgaggaaaccatcagcggaaagatttatctggacagagagaaaatcacgaagaacgatattcttacagccacccgcaaaacagtcgactcctctttcgatgacaagcggatcaaaaagatcaccgataccggcattcaaaagatcctgctcaattacctgaaatataaggggagccccgaaattgctttttcccctgagggcctcgaggaactgaacaaaaatctttctatctacaacgacggaaagccccacaaaccgatttataaggtgagaatctacgagaagggcagcgggcgcttcgccctgggagaaaaaggccggaagtataaaaagtacgttcagggggcgtccaatctctactttggaatttatcagggcgccaaacgcagcttcgctacaatccctctgaacgaggtgatcgaaagacagaagcaagggctgccctctgtccccgagtacaatgagaagggcgaccttctgctcttttccctgagccctaacgatctcgtgtatgttccgattgaaggagagatcattgaaaatatcgacttccggaacctgtctaaagagcagaaggaaagaatttacaatgtgaacgatttttccagcacgtgttatttcacccccaatcggatcgccaaagctatcttccctaaggaggtcgaccttcagcgcaaaggcgataagctgtctgggtcctacgacacaaagaccgccagcctggaggggattcaaatcaaagaagtgtgcattaagctcaaagttgatagactgggcaacatctccaaggcctga

SEQ ID NO: 4528 - RNA, 4314 nt, synthetic construct
  misc_feature 1..4314: note = Cas9 variant
  source 1..4314: mol_type = other RNA
atgaagtacatcaaatatattctgggcctcgacatcgggagcaactccattggatgggccctgatccagcttgatctgctccaaaagaccaaaagaattatcgctacaggctctcggatcattcccatggaccagaaggtgctgagcgatttcgggaaaggaatcacgatttcccctaccgcccagcgcacatcttacagaaatgcgcggcactgccgcgagagacatcttctgcggcgcgaaagactccaccgggtcctgcatatcctgggctttctcccgacccactatgacaagcagattgatttcagcaagcgctacgggaaatttgttgacaacacagagcccaagatcgcttataatgaaagaaaattcctgtttatggattccttccaagagatgcttgccgactttaagattcatcagcctgatctgttctacaccaaaaagaacggagaagagtctaagatcccctatgactggacaatctactacctccggaaaaaggccctgagccgcaaaatttccaaggaggaacttgcttggatcattctgaattttaaccagaaaagaggctattaccagctccgggaggaagaggaggaaaataaggagaacgatttcgaaatcattagctctaaaatcatctccgtgattaagaaggacaaagataagaaatataataagtactggtatgacatcattctggagaacggcctggtgtaccaagccgctttttataatgacttcgtctacaactggatcaatcaggatcgcgaatttattatcgagagaatcagcctcaaaaacgggaccgagaaggtgaagctgtcttaccttcctacgttcgacgaaattgataaaatggacaagaaagagcaggataagtattacaaaaagatcaagattaaaaccgaaaattccatcggaaacaagacagttggctgttatatttacgaccacatcctgcagaaccccaatgagaaaattaaggggaaactcgtgcggaccatcgaaagaaagtattacaaggaggagctgaaagccatccttgaaaagcaagtcgcgctgcagcctgaactcttcacagatcagctgtttgccgactgcattcgcgaactgtatagcaaaaacgaggctcaacagcggaatctcgccgctagagatttcgtgcacctgtttgttgaagacatcattttctaccagcgctctcttcggagacagaagtccaccctggccaactgtagcctcgagtcccgctcttacatcgataaagacagccatacgcggaaggaggcgccgctgaaagtgtgccccaagtccaatccttattaccaagaatttagagtccttcagtggctgcagaacctcaagatttatgagatcgacacagatcaggaagtgacccacgagttcatcaaaacactggaggacaagcaacagtttttcgattttctgatgaatcagaaagaaattgactgtgaggaactcctgaagtacttccttaaccagacctatcccaatgcccgcgagaaagctctgaagtccgaactcaagaaatggaaggatacctaccggtggaactatgtgtacgacatcggagagaaatcttccaagaaataccctatgaatgagacaagatatgaactgaagcgccatctggagaaggtcgccaaccttcccgatgactttctcagctctgaagttgagtacctgctgtggcacctcatttatagcgtgaaagataaggtggcttacgaaaaaggcctgaagacgttcgcccaaaaacaccatcttgacaaggattcctttgtcgagtctttcaagaaattcaagccgtatcctagcgagtacgggtcctttagcgaaaaagccatccggaagctgctccccctgatgagattcggatcttattgggactttaatcacattgataaaaacacccagaagcggatcgaggacctgatcacaggcgtggaaaatgaggaaattcgcaccatccttagagagaaagctgagaagtaccagctcgaaaaggagacagacttccaggatctgcctctgtggctcgcgcaatacattgtttataaccggcatgccgaagctagcagcctggagaaatggacctctgtgaacgaccttgagacgtacctgaatgaatttaagcagtattccctcagaaaccccatcgtcgaacaggtggttatggaaacactgcgcgtggtccgggatatttggcaacagtacggccaggggcaggccagcttctttgacgagatccacatcgaactgggaagagagcttaaaaagaccgccaaagagcgcgaaaagctctccaagcaaaatcagaaaaacgaggatattaatctgtctatcaaggaaaaactgaaggagctcgaaaaatataacaccagagcttacagcattacacatcaggagaagtataagctgtggcttgagcagaaacacatctccccctacaccggccaaattatctctcctgaaaatctgttcacagacaactacgagattgaacacatcatcccgcagagccggtttttcgatgactccctcagcaataaggtggtctgcgagtctattgtgaacaaagccccctataaggatcgccagctggggctggaatttatcaaaaatcagggaggcagaattgttaaggagctttccacggagaacaagaccatcaaaattttcacagaggagcaataccggacctttatcaaggaacattatagcaataaccctgagaaaacaaagaaactcctgctggaggaaatccccgagaagatggtggcgcgccagatgaatgacacctgttacatttctaagttcatctccgaaattctcagcaaaatcgtcagatctgatgagcaggacgaaggggtgcacagcaagaacgttattctgtgcacgggaaaaatcacctccgctcttaagcaagattggggcgtgaacgacgtctggaatgacctgatcctccctcggttcgagcgcatgaacgatctgacacagagcaccctgtttacaacctataatgagaaataccagaagtatcttcccacggtgccgatggaatactctaacggcttccagaaaaagagaattgaccatcggcaccacgccatggatgccatcattatcgcttgtgccacacgcgagcatattaattacatcaacaatcaacacgctctggaaaaggggaaagacaagaaagagaagcagaaagaacatgataagctcagagagaagctgtgcattaaaaaggacaacaaaggatccgaggaaaattatagctggatctttaagaaaccttgggataccttcacacaggaggtgcaggccgcgctcgaaggcatcgttgtctcctttaagcaaaacctgcgggtgattaataaggccaccaactactatgagagatgggtggaagagaatgggaaatacatcaagaaaatggtcaagcaggagggaaccaactgggctattcgcaaaccccttcacgaagagacaatctctggcaagatttatctggaccgggaagagatcacgaagaatgatatcctcaccgccacaagaaaaaccgtggacagctccttcgatgagaagcgcattaaaaagatcacagacaccgggattcagaaaatcctgctgaactaccttaagtataaaggctctcctgaaattgcttttagccccgagggactggaggagctcaacaagaatctgtccatctacaacgacggcaagcctcataaacccatctacaaggttcggatttatgaaaaagggtctggaagattcgccctcggcgagaaggggcgcaaatacaagaagtatgtgcagggagcgccgaatctgtactttggcatctatcaaggggccaacaaacggagcttcgctacgattcctcttaatgaggtcatcgaaagacagaagcagggccgcccctccattcccgagtacaacgaaaaaggagatcctctgctctttagcctgtctccgaatgacctggtgtatgttcccgtggagggcgaaatcattgaggatatcgacttccagaacctttccaaggagcaaaaagaacggatctacaatgtcaacgatttcagctctacatgttactttacccctaatagaattgccaaggctatcttccccaaggaggtggacctgcagcggaaaggggataagctccctggatcctatgacaccaaaacagccagcctggaaggcattcagatcaaggaggtttgcattaaactcaagatcgatcgcctggggaacatctctaaggcctga

SEQ ID NO: 4529 - RNA, 4317 nt, synthetic construct
  misc_feature 1..4317: note = Cas9 variant
  source 1..4317: mol_type = other RNA
atgaagaccatcctgggcctcgacctggggacaaacagcattggatgggcccttatcaaacagaatttcgagaacaagtacggcgaaattctggggatgggatccagaatcattcccatgtctcaagatatcctcggcgagtttgggaaaggaaatagcgtgtcccagacggctgcccggaccgactatcgcgcgacaagacggctgcgcgaaagattccttctgcggcgcgagagactccaccgggtcctgaacgttctgaattttctccctgaacattacgcttctcagatcgatttcgacaagcgctttggcaaattcaaggtggagaccgagccgaagctggcctggaaaaacattgatggcaagtttagcttcctttttcagacatccttcaatgaaatgctggaggactttaaagcccacgggcaagatctcaaggtgccctatgactggaccatctactatctgagaaagaaggctctttctcagaagattgaaaaagaggagctggtctggatcctcctgaacttcaatcagaagcggggatactatcagctgcgcggcgaagaggaagaggaaaaccctaataaactcattgagttttacagcctgaagatcattgatgtgcttgccgacgagccccaaaaagggaagtccgatatctggtacagcctggttctcgaaaacggatggatctatagacggtcttccaaaacaagcctgcttgactggaaggataagattcgcgacttcatcgtgaccacggacctgaatgatgacggctctgtcaaaaccgataaggaggggaacgagaaaagatccttccgggctcctggagaaaatgactggacactcgtgaagaccaaaacagaacaggagattgatagaagccgcaagaccgttggcaactacatctatgagacgctgctgcagaaccccaagcagaaaattaagggcaaactcgtgcggacaatcgaaagaaagttttacaaagaggaactgaagcgcatccttgagaagcaaaaagaatttcatcgggagctggagtctaatgacctctataacgattgcattagagaactgtaccgcaataacgaggcccaccagcttaccctgtccaagaaagactttgtccatctcttcatggaagatatcattttctatcagcggcctctcaagagccaaaaatcctctatcagcaattgtacactggagttcagaaagtacaaggacgagaacgggattgaacacacccagtttctgaaagcgatcccgaagtccaatccctactatcaggagttccgcatctggcagtggatttttaacctgaatatctacaaaaaggataacgacgacaatgtgaccaaagagttccttaacacaacgcgggattttgaaaatctgttcgaatttctcaacaatagaaaggagattgagcaaaaacctctgctgaagttccttctcgaacagaaggagttcaaaggaaagctgctgaacgccgaaaccgagaaatttcgctggaactatgtggaagacaagaaatacccctgcaatgagacacggaccatgatcagcgagagactcaagaaggtcgaaaacatttctgatgacttcctgacacgggagatggaacagaaaatctggcacattatctattccgttaatgataagaccgagtacgaaaaagctcttaagagctttgccgagaaaaacaatctggacgagaactctctcttcgaggcttttaagaagctgcctcccttcaaaagcgaatatggctccttttctgaaaaggccatcaaaaagctgcttccgctcatgcgcctggggaaatactggagctacgcgaagattgatctgtattccaagaatagaatccagaaaattatcacgggagagttcgacgagaacattaaggatcgggtgagagaaaaagccatccgcctcacagctgagaatgactttcaaggcctgcagctttggctggcccagtacatcgtgtatgggcggcatagcgaggcttctatgattggaaagtggaactccgccgatgacctcgaagagttcctgaaagaatttaagcagcacagcctgagaaatcctatcgtcgagcaagtgattaccgaaacccttcgcatcgttaaagatatttggctcaagtacggcaacggcgccaaggacttctttaatgagatccatatcgaactggggagagagatgaaacagacaaaggacgaacgggctaacgcgaccaaaacaattacggagaatgagaacaccaacctgcgcatcaaggccctcctggctgaaatgatgaatgatcactctgtggagaacgtcagaccctattcccctatgcagcaggaaattcttaaaatctacgaggacggcattctcaagagcgatatcgaaatcgacgatgacattctgaagatctccaaaacagcccaaccctctagctccgatctgaagcggtataaactgtggcttgagcagaagtacaaatctccctacaccggacagattatccctctcaataagctgttcacaccggagtatgaaattgagcacatcattccccaaagccgctacttcgacgattcctttagcaacaagatcatctgtgaatctgccgtgaataaactgaaggacaactatattgggctcggattcatcaaacagtttggcgggaccattatcgagtgcggcttcggaaagagagttaaagtgtttgaggtcggcgaatacgaggagttcgtgaagaagcattatgctaataaccgggggaaacgcaataagctgcttctggaagaaattcctgagaaaatgatcgagagacagatgaacgatacgcggcacatctccaagtacattagcggaatcctctctcatattgtccgcgtggaagacggcaccgatgagggggttaattccaaaaacgtgatccccggaaatggcaagattacaacccagctgagacaagactgggggctgaacgacgtctggaatgaacttatcctgcctcggtttgagagaatgaaccagctcacaaacagcaccgatttcacgtcttggaatgaaaaccaccagaagtatctgcccacagtgccggttgagtttagcaaaggcttctccaagaaacgcatcgaccatcggcaccacgccctcgatgcgctggtgattgcttgtgccaccaaggaccatgtcaatcttctgaacaatcagagcgccaaatctgctacaaagagatacgatctcaaaaagaagctgatgaaatttgagaagaccgtgtacaaagaccctcaaaccgaaaagcgcatcgagcgggaagtgcccaaacacttcctgaagccttgggagacattcacggttgatgccaagaacagacttgaaaccattatcgtctcctttaaacagaatctgcgcgtgattaacaaggctacaaattattacgagaaatatgtggagaaggacggagtcatgatgaaagaacgggtggagcagaccggcacaaactgggccatcagaaagcccatgcataaggaaaccgttagcgggaaaattgatctcccttgggtgaaggtccccaaaggaaagatcctgacggcgacacgcaaatccctcgacacctctttcgatctgaaggccatcgctagcattaccgacacaggcatccagaagattcttaaaaattacctggagtttaaggagtccccggaactcgccttctctcctgaggggatcgaagacatgaacaaaaatattgagaagtataacggaggccggccccaccaacccatcagcaaagtgagagtttttgaactggggtccaagttccaggtgggccagaccggaaataaaaaggataagtacgtcgaggctgccaaaggcacaaacctgtttttcgcgatctatgaggacaagaaagggaagcggtcttacgaaacgattcctcttaatgaggtgatcgaacgccaaaaacagggactgagcgttgtggatctcaagaacgtcaacgactttttcctgtgcccgaatgatctcgtgtacattccctccggcgacgagtttgaaaacagagggagcatcgagattgagaatatcaccaaggaaaaatctgagcggttctataaggtggtctcctttagcggatctcagatcttcttcgttcgccacgatattgccgtgtccatcgtgaacaaaggcgaatttagcacactgaataagatggagagagctattgacgggtctatggtcaaagaaatctgtattaaacttaagatcgatcggctgggcgacgtgctgaaagcctga

SEQ ID NO: 4530 - RNA, 4317 nt, synthetic construct
  misc_feature 1..4317: note = Cas9 variant
  source 1..4317: mol_type = other RNA
atggtgaagaaaggctacaccatcgggctggacattggaacaacgagcgtcggctgggccgttaccgatgacgatttcgagctcgtgaacaagaaaatgtccatcaaggacaaatctgggagcacaattaagagagtgcggaagaatctgtggggagtccgcctttttgatgaagctaaaaccgccgagaacacaagacggacccgcggcgtgagacggcgcatcagacggcgcaaggaaagactgaattatctccaggggattttctcctctgagatggcgaaaatggacgaaaactttttcatgcggctggaggagagctttttcaaactttccgataagtctgaacaaaataagtttccctacgctctgttcaagaacgagatcgaagagaaagcctattaccgccagtttcctacaatctatcacctcagaaagcatctgatggagcacgaagagagcgacctgcggaaaatttacctcggactgcatcacatccttaagtatcgcggccatttcgttcaggaaggccagaaaatggatgtggccaatattgacatccaagggaacctgaaggagctctttaatgctctgaacgaaaatttctccaacaaagaggatgactttgagcaggaaagaatgaaggatggagtcaagcgggccaaagtgcttttcgacaccgagaagctggctgccgttgaagagattctcaaagaaaagatcagcaaatcttggaaggtgaataagatttccaaaggcatcctggcggagaagaaagacctgccgatcttcaaggccattgtcgggaacaaaatcgatctcgctggaatttttgactgccccgattacgccgagaaggtgaatgaaagcatcaaggagctgaaagacaaggtgtacttcaacaaagaagattttgaggaaacgttcgagaaactttctcagctgctcaaggaggaagaactggaaattcttatcctggctagaaagtgttatgaggccgtcctcctggcggacatcatgcagggcgagcaatccctgagcgatgccatggttgctaagtacaacgaccacaaaaaggatctcgtgatttttaaaaagttcgtgatcgactatttttctgaagatgtctacttcgacctgtttaaaaatacccagcttgccgggaactatcactcctacgtgaagggagagcgcaaaggcaataagttcaaccatgctagcctggacgatttttataagttcgttaaaaaggaactcgacaaaaaggccgaggaactgtccgagcaccctgtgtacaaacagattcttcagaagatcgagctggaaacatttctccccaagcaacggatgttcaaaaatggcgccattccttaccaggtccatctgcacgagctgagagctatcatcaagaaacaggaaaagcgcttcccctttctcgcggagaaaattatcattaaggataaccaaaaggacatctctgaatataaaattgagaccctgatgaagttccggatcccttactatgtggggccgcttattgaggccagagaaggagagctgggcaaaaagcgcacaaattacagccggtttgcttggatgcagaaatcccccgaaagccagaacatcgggatcaccccttggaatttccactctgttgtggataaggacgcctccgccagcgagtttattgaaagaatgacgggattctgctcttattttcccgaggagcctgtcctccccaagaacagcctgatctaccagcaattcacagtgtttcaggaactgtccattgtcggctattacgatgagcagaatcgcaaacattaccttgacggggaaacccggagacgcatcttcgaggatctctttaagaaaaaccggacagtgtctgctggactgctgagaaagtggctcgtttgtaatcagcggaccagccaagaggaaaaagagattcgcctgttcggccttgacctgaagaaaaacggcctcgggtccggaaattttaacaccaagtatacaacgtacctggatctgaaggacgccggcatcaccgaaaaacagcttaagcagcacaaagatttcttcgagaagatcgtgaaatatcagacaatttttgaagacaagaagatcctcaaaagacggattatcctgctgaacgaggagcaaccgctcctgagcgaggagcagattaagaatcttgcgaaaaagcattacaccgggtggggaaacctgtctctcaaactgatcgacggcatccaggataaggggaagacaattctggactatcttgaaacccaggattacaatcaaaacctcatgcagctgatgaatgacgagaacaaatccttcgaaatgcagatcgagcaagctagagccggcaaggtccagtttggaaaaattgattatagcttcgtggagcagctggccggctctcctgctatcaagcgcgggatttggcagtccctccaaatcgttgaggaactggtggcctttcttggaaaagaaaatatcaagaagattgtcatcgagatggctcgggaaaaccagagctccaaaagaacgaagtctcgccagaaacagattgaggccctgtaccaaaaggtgacaggcgacctcaaaaatgagcaggaaaagatcgatgtgatgcagaacttcgacaatgagagagtttttctgtactatctgcagaacgggaagtgcatgcacagcggagaaaaacttgagctctcccaactgtctgagtacgaaattgatcatatcattccccagacctatatcaaggacgatagcttcgacaataaagtcctggtgacccggaacgcgaatcagcaaaagggcggggatgtgccttcctacgacgtcatcgacaaaatgaaaagctattgggagaagctcaaggaaaacaacctgatttctgagaagaaatttgccaatcttacaaagggcaaattcgatgaccagcagctgtccggatttatcaaccgccagctcgtggaaaccagacaaattacaaagaatgttgctatcattctggataaaatctacaacgacgaggccaagaatgagaaggaagtggctatcattacgctgaaaagcgcccttacctctcagtatcggcagggcatcatttacgtccccaacgatgacttcgatgagctgaagctcgtgtccaaaacaaatagccgcctgaaggaagttaaactccacgacgggttctacaaggtgagagagatcaacgattatcaccatgcgcacgacgcctacctgaataacgtcgtggctacctatctttacgaagccatgcccgatctgcggcctctctttgtttatggagagcattctcgcgagattcacaagagattcctgggcaaatacgctacaacccggaaggggcagtttaaacaactgcttgtggacatgcaggacgaatattggatgcgcaaggataaagagggaaatttcatcgacggcgaaatcctgtggagacgggatgaggtcctccagattgtgaagaaggtgctggactacagaaacatccagattacgaaaaagctcgaaatgatggtcaccgggggcgaggagaaatccttttaccaagatagccgctgtcggaaggacaaaacagccatcccgtataagaccaattgggatcccagcaaatacggaggcttcaagtctcctagaacagcctatgctattcccgttatcaagaaaaacaagcctaaactggaacccgtgcttctggtgaatcgctccaaggtcgagaccgacgggcagtttgattgcgaaaaattcaaggagctcaacccgacgctgaagattctgggacagcctatctggaaataccagagctttgagatgttcgacggcacaaagcggtatatcgcgtccgcctctgaaattcacaaagggaaccaaatcaagtttagccaggagcatatgaaattcatttcctgttgccagaagtacgatgaagtgaagaataaacttgcttttgacttcgttaacgagtctaagcacctgttccaagaaatcctcaccgccattaaagataatatccatagatatcgcctgatcgccgagggaattgaggtgcaccggaagtttagcaacatgctcgaaaatatcgagaaactgtccacacaggaacttgtcgacaacctgctggacgctattaatatcacctctgtgggcaccacaaacaatgccttcgggagagttcgctacaagggcagctacctcaacgagatttggtccgcgacgctgatccatcagagcgtgaccggactttatgaaacacgggagaagctgatctga

SEQ ID NO: 4531 - RNA, 4323 nt, synthetic construct
  misc_feature 1..4323: note = Cas9 variant
  source 1..4323: mol_type = other RNA
atgaagaccatcctgggcctcgacctggggacaaacagcattggatgggcccttgtggagcaggatttcgaaaataaacaaggcctgatcctcgggatgggatccagaattatccccatggacgctggcattatcgggaagtttgccgagggatctagcatctcccagacggcggaacggaccggctaccgctctattagacggctgcgcgagagacaccttctgcggcgcgaaagactccatcgggtcctgaacatcctgaaattcctccctgagcactatgctgccgagattgattttgaaaagcgcttcggccagtttctggccgagacagaaccgaaacttgcttggaaaaagagcgccgaggggaaattcgagtttctgttccagagatcctttgacgaaatggttgctgatttcaaggccaatggacaagacatcaaaattccctacgattggaccatctattacctccggaagaaagcgctgacacagaagatttctcctcaggagcttgcctggatcatcctgaactttaatcagaagcgcggctattaccaactcagaggggaagaggaagaggagaaccccaataaaaaggtggagttctatagcctgaaaattgtggacgtcgtggctgatgaacagcctaacaagaaaggagacacctggtactccctgcatctcgaaaatggctgggtttaccggcgcagctctaagatccccctgtatgattggaaagacaaggtgagagattttattgtcacaaccgacatcaacgaggacgggtccgaaaagctggataaagacggagaggtgaagcggagcttcagagcccctaaagaggatgactggacgctgattaagaaaaagaccgaacaggagatcgaacagttcaatcaaacagttggctcttacatctatgaggctctcctggataacccgacccagaagattcgcggcaaacttgtgcggacaatcgaaagaaagttttacaaatccgagctgaagaaaattctcgagaagcagatcgaactgcaacccgagctgttcaccgaagacctctataatgcctgcgcgcgcgagctgtaccggagcaacgtcgcccaccagcagcagctttcttccagagattttgtgtatctgttcctcaatgacattatcttttaccaacgccctctgcggagccagaagtcccttatctctaactgtagcctggagttcagaacgattaaagataaggacgggaacggacagatcatttacctcaaagctatccccaagtccaatccttattaccaggaatttcgcgtgtggcaatggctgtataacctgaaaattttcacaaaggaggatgacaaggacgtcaccaatcagtttatcaacaaagttgaagatctcgaggccctgttcgaatttcttatgaatcagaaggaggtgaaccatacagacattctgacctacctcatcgagcccatcgtgaaaagcaagtatccgaatgctaaaggcaaggccttcaaagatgaactgaagaaggagctgaaaaagtaccggtggaactatgtctacgacgccgataaagacgaatctaagtcctaccctatgaatgagaccagatatgaacttcgcaaacggctcgataaggtggagaacgttcccgctgactttatgacaagaaagattgagcagcacctgtggcacatcatttacagcgtgacggataaaatcgagttcgaaaaggcgctgaaatctttcgccaataagtatgacctccatcaagagagctttgtcgaaaacttcaaacggtttaagcctttcgattccgactacgggacctattctgaaaaggctattaaaaagctgcttcccctgatgcgcgtgggaaaatactggagctgggagggcatcgataataacacaaagaaaagaatcgggaagattatcaccggagagtatgacgaaacaattaagaatcgggttagagagaaagccatcgacctcaccgaagagaaccactttcagggcctgcagctgtggcttgcccagtacattgtgtacgatcgccattccgaggctgacatcgccggcaagtggaacagcgtcgcggatctcgaacaatatctgtctgagttcaaacagcactccctgcggaatcccatcgtggaacaggtcattacggagacactcagagtggttcgcgacatctggaagcaatacgggaaaggagctaaggattattttgacgaaattcacatcgagctgggcagagagatgaaaaacaccgccgaggaacggaagcgccttagctctattatctccgaaaatgagaccacaaacctgagaatccgggccattctcgaggaactgatgtacgatgagaatatggaaaacgtgcgcccttatagcccgatgcagcaggaggctctgaagatctacgaagacggggtcctttcctctagcgtggagattcccgaagatatcgagaaaatttccaagaaatctgagcctaccaagagcgaaatccagagatataaactctggctggagcaaaagtaccggtccccctacacaggacgccctattcccctgagcaaactcttcacgccggcctatcagatcgaacatatcattcctcaggctagatttttcgacgatggcttttctaataaagttatctgcgagtccgaggtgaacgccctgaaggacaaaatgcttgggctggagttcattcagaattactatggccaaaaggtcaccaccagctttggagaagtgacaatcctcacagaagatgcgtacaaagccttcgtgaaggagcactatgacaagaaccggtctaaacgcaataagctgctgcttgaagagattcccgagaaaatgatcgacagacagatgaacgatacccggtacatctccaagtatattagcaaagttctctctaatctggtcagaggcgaaaaggacgatgagggggtgaacagcaagaatatcattcctggaaacggcaaaatctccgggacgctgaagcaggactggggactcaacgatgtgtggaatgacctgattcttccccgcttcgaacggatgaaccagctgaccaatagcacagattttaccgcttggaacgagaaacatcaaaagttcctccctacaatccccctggaactgtctaaaggctttcagaagaagagaatcgaccaccgccatcacgcccttgatgctctgattatcgcctgtgcgacccgggaccacgtcaatctcctgaacaataaacatgccaagtccagaaacgagcgctacgatctccagcacaaactgcggcatacgacaccgtggcaagacaaggaggggaaagtgagaaccaagttcacagaatttaaaaagccttgggagaccttcacccaggacacaaagaaagaacttgagaagattgttgtgagctttaaacagaatctgcgcgtcatcaacaaggctacgaattactatgaaaagattgtggatggcaagaaggttatgttcaaacaggagggagtgaactgggccatccggaagcccatgcacaaagagaccgtctccggcaagattgacctccccagagtgaaagtttctaaggggaagatcctgacagctacccggaaaagcctggatacatcctttaatgccaagaccatcctttctattacggacacaggaatccaaaagattctgctcaactacctgaaggccaaaggcaatcctgaactcgctttcagcccggaggggatcgaagagatgaaccagaacatttccctgtataatgatggaaagccccaccagcctatccttaaggtgcgcgtctttgagcagggctctaaattccccctgggggaaaccggcaacaagaccacaaaatacgtggaggcggccaagggaaccaatctcttctttggcgtgtatgaaaacaatcaagggaaaagaagctacaacacaatccctctgaatctggtcattgagcggcagaagcagggacttaactccgttcccgaaacgaatgagaaaggccatcgccttctcttcagcctgtctcctaacgacctcgtgtatgtgcccatcgagggggaagtctttgataagaccaatccggacgtgaacagaatttacaagatcgtttccttcagcggatctcagatgttttgcgtgcggcaagatgtcgctacatccattgtgtacaaactggagttcagctctcttaataagatggaaagaaccatcgacggcatcatgattaaagagatctgtattaagctgaaagttgatcgcctggggaacatctccaaggcctga

SEQ ID NO: 4532 - RNA, 4323 nt, synthetic construct
  misc_feature 1..4323: note = Cas9 variant
  source 1..4323: mol_type = other RNA
atgaagaccatcctgggcctcgacctggggacaaacagcattggatgggcccttgtggagcaggatttcgaaaataaacaaggcctgatcctcgggatgggatccagaattatccccatggacgctggcattatcgggaagtttgccgagggatctagcatctcccagacggcggaacggaccggctaccgctctattagacggctgcgcgagagacaccttctgcggcgcgaaagactccatcgggtcctgaacatcctgaaattcctccctgagcactatgctgccgagattgattttgaaaagcgcttcggccagtttctggccgagacagaaccgaaacttgcttggaagaagaatgccgaggggaaattcgagtttctgttccagcggagctttgacgaaatggttgctgatttcaaggccaacggacaagacatcaaaattccctacgattggaccatctattacctcagaaagaaagcgctgacacagaagatttcccctcaggagcttgcctggatcatcctgaattttaaccagaagcgcggctattaccaactcagaggggaagaggaagaggagaatcccaacaaaaaggtggagttctattctctgaaaattgtggacgtcgtggctgatgaacagcctaataagaaaggagacacctggtacagcctgcatctcgaaaacggctgggtttaccggcgctccagcaagatccccctgtatgattggaaagacaaggtgagagattttattgtcacaaccgacatcaatgaggacgggtctgaaaaacttgataaagacggagaggtgaagcggtccttcagagcccctaaagaggatgactggacgctgattaagaaaaagaccgaacaggagatcgaacagttcaaccaaacagttggcagctacatctatgaggctctcctggataatccgacccagaagattcgcggcaaacttgtgcggacaatcgaaagaaagttttacaaatctgagctgaagaaaattctcgagaagcagatcgaactgcaacccgagctgttcaccgaagacctctataacgcctgcgcgcgcgagctgtaccggagaaatgtcgcccaccagcagcagctttccagccgcgattttgtgtatctgttcctcaacgacattatcttttaccaacggcctctgagatctcagaagtcccttatcagcaactgttccctggagttccgcacgattaaagataaggacgggaatggacagatcatttacctcaaagctatccccaagtctaacccttattaccaggaatttcgggtgtggcaatggctgtataatctgaaaattttcacaaaggaggatgacaaggacgtcaccaaccagtttatcaataaagttgaagatctcgaggccctgttcgaatttcttatgaaccagaaggaggtgaatcatacagacattctgacctacctcatcgagcccatcgtgaaaagcaagtatccgaacgctaaaggcaaggccttcaaagatgaactgaagaaggagctgaaaaagtacagatggaattatgtctacgacgccgataaagacgaatccaagagctaccctatgaacgagacccgctatgaacttcggaaaagactcgataaggtggagaatgttcccgctgactttatgacacggaagattgagcagcacctgtggcacatcatttactctgtgacggataaaatcgagttcgaaaaggcgctgaaatccttcgccaacaagtatgacctccatcaagagagctttgtcgaaaatttcaaacgctttaagcctttcgattctgactacgggacctatagcgaaaaggctattaaaaagctgcttcccctgatgagagtgggaaaatactggtcctgggatatcatcgacgacaagacaaaaacccggattggcaagatcattacaggggagtatgatgagaccatcaagaacagagttcgcgaaaaagccattgacctcacggaggaaaatcactttcagggactgcagctgtggcttgcccagtacatcgtgtacgatcggcattctgaggctgacatcgccggcaagtggaacagcgtcgcggatctcgagcaatatctgtccgagttcaaacagcacagcctgagaaaccccattgtggaacaggtcatcacagaaaccctccgcgtggttagagacatttggaagcaatacggcaaaggggctaaggattattttgacgagatccacattgaactgggacgggagatgaaaaataccgccgaggaacgcaagagactttcttccatcatcagcgagaacgaaacaaccaatctgcggattcgcgccatcctcgaggaactgatgtacgatgagaacatggagaatgtgagaccttattctccgatgcagcaggaagctctgaagatttacgaggacggcgtcctttccagctccgtggaaatccccgaggatattgaaaagatctctaagaaaagcgagcctacaaagtccgagattcagcggtataaactctggctggaacaaaagtaccgctctccctacacggggagacctatccccctgagcaaactcttcaccccggcctatcagatcgagcatattatccctcaggctcggtttttcgacgatggattttccaacaaagttatttgcgaaagcgaggtgaatgccctgaaggacaaaatgcttggcctggagttcatccagaactactatgggcaaaaggtcacaacctcttttggcgaagtgacaattctcaccgaggacgcgtacaaagccttcgtgaaggaacactatgataagaatcgctccaaaagaaacaagctgctgcttgaggaaatccccgagaaaatgatcgaccggcagatgaatgatacgagatacattagcaagtatatctctaaagttctctccaacctggtccgcggagagaaggacgatgaaggcgtgaatagcaagaacattatccctgggaatggaaaaattaccggcatcctgaagcaggactgggggctcaacgatgtgtggaacgacctgatccttccccggttcgagagaatgaatcagctgacaaactctaccgattttacagcttggaatgaaaaacatcaaaagttcctccctagcgtccccctggagctgtccaaaggatttcagaagaagcgcattgaccaccggcatcacgcccttgatgctctgatcattgcctgtgcgaccagagaccacgtgaacctcctgaataacaaacatgccaagagccgcaatgaacggtacgacctccagcacaaactgagacatacgacaccgtggcaagataaggagggcaaagttcgcaccaagttcacagagtttaaaaagccttgggaaaccttcacccaggacacaaagaaagagcttgaaaagatcgtggtcaactttaaacagaatctgcgggtgattaacaaggctacgaattactatgagaaaatcgttgatgggaagaaggtgatgttcaaacaggaaggcgtcaactgggccattagaaagcccatgcacaaagagaccgtgtctggaaagatcgacctcccccgggttaaagtgtccaagggcaagatcctgacagctacccgcaaaagcctggatacatcctttaatgccaagaccattctttctatcacggacacagggattcaaaagatcctgctcaactacctgaaggccaaaggaaatcctgagctcgctttcagcccggaaggcattgaggaaatgaaccagaacatctccctgtataatgatgggaagccccaccagcctatccttaaggtcagagtgtttgagcagggatctaaattccccctgggcgagaccgggaacaagaccacaaaatacgtggaagcggccaagggcaccaatctcttctttggagtctatgaggacaaccaaggcaaacggagctacgatacaattcctctgaatatcgttattgaacgccagaagcaggggctgaactccgtgcccgagacgaatgaaaaaggacatagacttctgttctctctcagccctaacgacctggtgtatgtccccatcgagggcgaggtgtttgatgaaaccaatccggacgttaaccggatttacaaggtggtctccttcagcgggtctcagatgttttgcgtgagacaagatgttgctacatccatcgtgtacaagctcgagttcagctctctgaataaaatggaacgcaccatcgacggaattatgatcaaggagatttgtatcaaacttaaggtcgaccggctgggcaacatttccaaagcctga

SEQ ID NO: 4533 - RNA, 4332 nt, synthetic construct
  misc_feature 1..4332: note = Cas9 variant
  source 1..4332: mol_type = other RNA
atgatcaagctgctctacctggagaaacttaagcagtataccatgaaaaagattctgggcctcgacctggggacaagctccatcggatgggcccttgtgaacgaagctgaaaattctgatgaagtcagctccattatcaaactgggcgttagagtgaaccccctcacggtggacgagatgcaaaatttcgaaaaggggaagtctattaccacaaacgccgatcggaccctgaaacgcagcatgagacggaatctgcagcgctacaagctcagacgggacgcgctgatcgagcttctgaaaaaggtcggatttatcacagataaaaccattctctccgagcagggcaaccgcacaaccttcgaaacgtatagactgcgggctaaggccgccgaggaagagatctctcttaaggagctggctcgcgtgctcctgatgattaataaaaagagagggtacaaaagctcccggaaggccaaaggagaagaggaaggcgctctgatcgacggcatggagattgccaagaaactctatgatgaagacctgacccctgggcagctttgcctgcaactcctggagagcggaaagaagtttttcccggatttttaccgctctgaccttcaggaggagttcaacaaaatctgggattttcagaagcagttcaatctgttttccttctgtgacgttgcgaaagaggaagtgaagggcaaaaacaagagccaaacatgggccattctcgctaagtattttgtcgagaccaaaaaggtgaatgtttggaacgaacacgaggcccagacagagaatagagaagaggtgtacaaactggtcgggctgaagcggaccgtgaaaggagaagaactcaagaaggaaaactaccgctggagagtgcaggctctgacggagcagcttgatctggagaaaatcgccgtcgttctccaagaaatcaatggccagatttctgcgtccagcgggtatctgggagccatctctgaccggtccaaggtgctttacttcaacagacagacagtgggccaatatcagatggctgagctgaacaaaaatcccaacatgagcctccgcaatatggtcttttaccggcaggactatctggatgagttcaacgtgatttgggagaagcaggccgagttccataaagaactgacccctgagctcaagaaggaaatcagagacattatcatcttttaccaacgccggctgaaatcccagaagggccttatttctttctgcgagtttgaaaatagagaggttgtggtcgagaaagaagggaagaaacagacaaagatcattggatgtaaagtgatcccccgcagccaccctctgttccaggagtttaagatttggcaaaccctcaacaatatcgaagttttcgtgggcgagaagaaagggaagcggaaaaagtccaacgtcagctctgatctgtttggagacaccgaagatgctctgatcacagagggcagacgcttcctttatcaggaggagaaaaagattctcgccaaggaactgtccatcaaaaaggggctgacgaaagccgaaattctccggctgctttttgagaatccccaggaactggacatcaacttcaagcagattgatggaaatcaaaccggctttgctctcttcagcgcgtactctaacatgatcgagaaatacggctatgagcctctggactttaagaagccggccgaagatctgattagccagcttaaaacagtgttcaccgacctcgggtggaatacagatctgctgttcatcgacctcgacaaggagaacaaagaatgggagaagcagccctactttagactgtggcatcttctgtattccttcgagggagataatacccctacgggcaacgggaaactcatcgaaaagattatgcagctgtgcggaatcgagaaggaatacgctattgagctggccaacgtctctcttcaagacgattatggcagcctctccgccaaagctatcaagaaaattctgctgtacctcaaggaagggaatcagtatgacatggcctgtgagtacgcgggctaccgccacagcaaatcttccctgacaaaggaggaaatcgagaacaaagtgcttaaggataagctggaaatcctccccaaaaatagcctgcggaaccctgttgtggagaagattctgaatcagatggtcaacgtgatcaataccgttatggaagtgtatggaagacccgacgagattcgggtcgagcttgctcgcgaactcaaaaagtctgccaaagagagagaggaactgaccaaggccgtggctaagaacacacgggaacatgaggagatcagaaaagtgctgcaatccgaatttggcatgattaatgttagccgcaacgatatcatccggtacaagctctatgaggaactgaaagacaatgggtacaagaccctttattccaaccagtacattccgagagagaaactgttctctaaggagatcgatattgaacacatcattcctcagagccgcctctttgacgattccctgtctaataagacactggagtataaaagcatcaacatcgaaaagggaaataaaacggcctacgacttcgtcaaggagaaatacggcgaagaggggcttcagcaatatctgaacagatgcgagaacctctgtaaggataagaaagctaagctgcggaaactcaagatggaactgaatgagattcccgacggatttatcgaccgcgatcttagaaacacccagtacattgccaaaaaggcgctgtccatgctcacagaaatctgccggcgcgtggtggccaccacaggcagcattaccgacaagctgagagaggattggcagctggtcgacgtgatgaaagaacttaatctgcctaagtatgaggctctcgggctggttgaggtgtacgaagataaagacggccggaagatcaaacgcattaaggattggacgaaaagaaacgaccaccggcatcacgccatggatgctctcaccgtcgccttcacaaaggacgtgtttatccagtatttcaataacaagaatgcggcctgggagtctgattccaaagaacataccaacatcgttggaattaagacacgctactttgagagcggcaaagctgtgcctcccatccccctggggcaattcagagtcgaagccaagtgtcaccttgagaatctgctcgtgtctattaaagctaagaacaaggttgtgaccacgaatgtcaactgcatcaaaaagaaaggaggcacatataagaatacccagcagacaccgcgggggcagctgcacctggagaccatttacggatcccataaccaatacgtgaccaaaatcgaaaaggtgaatgccagctttgacgccgtcaagatcgctacagtttctaaacaggattatagaaacgcgcttctgaagcgcctcgaggtgttcggcaacgaccccaaaaaggccttcacggggaaaaatagcctggaaaagaaccctatttacctcgaccgggctcagaccatccaagtgcccgataaggtccagacagtggagctggagaccgcctatacaattagaaaacctgttgaccccacccttaatgtggataaggtcgtggacaaaaagatccgcctgattctggaacagcggctcaaagagtacggcggagatgccaagaaggcttttgttaacctggacgaaaatccgatctggcttaacgaggaaaaaggcatctccattaagagagtgacgatccgcgggattagcaaagcccaggcgctgcacgataagaaagacaaggatggaaatttcatcctcgacgagacaggcaaacggattcctgtcgattttgtgaacaccgggaataaccatcacgttgctatctatagaaagcccgtgctggacaagaaaggacaagtcattttcgacgatgagggcaatcctatgtacgaactcgacgaggatgtggtgccctttttcgaagccgtcacccgcgccaacctggggatccctatcattgacaaggattataaaaagtctgagggctggcagtttcttttctccatgaaacagaatgaatactttgttttccccaacgagaagacaggatttaatccgaaggaggtggacctgctggatcctgacaactacgctatgatcagccccaatctcttccgggtgcagaaaattggcctgaacgattataccttcagacatcaccttgaaacaacgatccaaaacgacctgaagtttattacctggatccggtgtgggaaatccggaatcaaggatattgtcaaagtgcgcatcaatcacattggccagatcgtttctgtgggggagtactga

SEQ ID NO: 4534 - RNA, 4332 nt, synthetic construct
  misc_feature 1..4332: note = Cas9 variant
  source 1..4332: mol_type = other RNA
atgaagaaaatcctgggcctcgacctggggaccgccagcattggatccgcttacgtgcttgaggccgaaaagtctgcggatcagacaaaaatcgtctatctgggcacgagaattatcctcagctccgctgacgccgagaacttctctaaggggctgagctgctcccccaccacagatcggacctttaaacgctctatgagacggcgccttcaaagatacaagcagcggcgcagctccctgattcagcagttcaagaaaatcggaatcattacaaataccgaacaaatcattagagagcctatcagcgaaacacacgagctcctgcggattcgctctaaggccgtttccgagcatgtgagcctggaagagtttgctagaatcctcctgaccattaacaaacggcgcggctataagtctaatagaaaaacgtccaagagcaccgaagaggacgggaaacttgtggatgccatggctgtcacaaaggagctgatcaagctcaaaaagaccccgggacagtacatgttcgaacggtttaaacgcggcaagtatgccgagatcgacttctacccctttgatctgattaacgaacttaaacagatctgggaggtgcagggccaaaagtatcctgacgttctgacagaagggctcctgtcttccctgctcaagcagaaaaccggaaaggcgaaagagctgatttacagcaagtccgatcttaatcccgccgaggtgcctatcgactaccagaaaggcaagaagctgagaaaaacgattctcaacaagtatttcgcttacgaatctcggagcctggccgtcacaaatatcatccccgtggagcaggctattaccgccatcgttgcgatttgtaaacaaatcaacaattccagcgggtatcttggagccattggcgatagatctcgcgtgctgtacgctaacaatcagacaatcgggcagtatctctacgaacggatcaaggccaaccctcacgaccggattcgcggagaggtcttttatcggcaagattacctggacgagttcgacagaatctgggaatgccagcagaattactatccggctattctgaccaacgatcgcaaacagtacatccggaatagaattatcttttatcaacgccccctcaagtccaagaaaagcgagctggccttctgtgaatttgagtctcgggaagtggagcataacggcaagaaatacaccgaaggccttcacgtggcccctaagagctcccccgtcttccagcatttcagactgtggcagcgcctcgggcagattgaggtttctcctctgcggaaatgggacaagcaaagcaacgagctttttgaacagcagaataacgctgatagagagggaatcctgaatacagaagcgaagcagaaactcttctcctatctgaacctgctcgaccacctgacggataatgagatccttaacattctgggctacagccccgacaagtggaaaatcaattttcgggagattatcgggaaccgcaccaataacctcatgatgaaggccttcttttctatgaaagaaatgacagatggagagcaaattgactgggaaaagaatctgaccaaaatcacaaacggccagtccctgatcagcccggagcagattgtggatcttatcagacagttctttgaacgggaggggattaccacgtctctcctgtatttcgaccctgctacagataattttagagagcaatcccactacagcctgtggcatctcctgtactcctatgaagacgacaactctcccaccggaaccacaagcctttgcaagaccctggccaagcgctacggcatccctcacgagctctgtcccctgctggcctcccttacattcgaacggcagtatggctctctcagcacgaaagctatgagaaagctgctgccctttatgcaggagaaacgctacgatgaagcctgcgagctcgcggggtatagacattccgcttggattaccaaggaggaaaatgccaaacggacactgaagaacaaacttcctctgctccgcaagggaagcctgagaaacccggtggtcgagaagatcctgaatcaaatgacccacgtgatcaacacacacattgccgaatacggcaatcccgacgagatccggattgaaatggctcgcgatatgcaggccaactctaaacagagaaaggctatgaccgccgcgatcacggaggccaccaaacggaatacacagttcattgaggaaatccaaaaggagtttgggttcaacccttccaagaatgaccttatcaaatataagctctggaaagaactggctcccctgggaaacaagaccctctacagcaatatttacatccctaaagaggagctgttcacagccaagtttgaaattgagcatatcattccccgcgctcttttctatgatgactctttttccaacaagaccctggaactcaatagcgttaacaaactgaagggcaataaaacggccctggattaccttgacacactcgggcaggagaaggcgaacgattatatcctgagagtggaggaactgaaaaagattggcgccatcacccaggctaaatacaagaagctcctgatccgggagaaagaccttggagatgacttcacaaatcgcgatctgaccaacaccagatatattatccggcacgccgctgacagagacctcacaaacacgcgctacattatccggcatgccgccgatatgctgctgcaggtcaccccgtctattgtgcacacaaatggcagcatcaccgctatccttagacgcgactgggggctgctcgatattctgaaggaactcaacctgcctacatatgagtccatcgaccggaaaattagcgatcccgaagagaaacttacccaatctgttgacagaaaggatggacaggcgatcaagatgattaaggactggtccaaacgcgatgaccatcggcaccacgccatggatgctctgatcacggccctcacaaccagaaagcatgtgcagtacctgaatggcaacagcggggccgaagagaccgacaaagctcagaagctggagcaacttaaagccctgcgcaagcagctcatcggatccgatggccactttattcctcccatgcatgacatccgggtccaggcgaaggaagctctgtctagagtgattatcagcacaaaagtcaaggggaaagtgaccacacctaatacgaacattatctgttcccgggacaagaccacaggccgcaaaatttacgttagacaaaccacactcacccccagaggagccctgcaccttgatacgaagtatggcatcaatcgctactatcaggagagagaagtgtctatcgggagcaagctgacccaggaggaaattcggctcgtctcctctccgcacatccagagcattctgctggagagacttcgcgccttcgacaacaatcctaaatccgcttttacaggacggaacagcgtggataagaaacccctggaggacaagaataaaaagctcgtttacaccgataagaaagtgaagcaaacaatcctggccaacagattcgtcaaacgcgaccgggttaattctaagctcgatctggacaacgtgattgataccggcatcaaaagaatccttgaacgccggctgaagcagtatgggggaaaatacgagacagcgttttccgacctggaaaataaccccatttggctcaacgaggagaagggcatcgctattaagagcgtgagaatccgcgggaaaaataacaccattacgatcagacagacaaatacctgccggatcaagtatgtcgccaacgataataaccatcacctggccgtgtacgcccttcctgacggctctattaaagacgatatcgtgtccttctttgacgctgtcgaacgcagcagaaagcggctgccgattatcgataaacataagaatcagtctctcggatggaagtacctgttctccattaaacaaaacgagtattttctcctgccccaacaggtggaaaagatcgacattgataccggcgagatcagcatgcagacaaccttctcccctaaagaccttagccacgaatacatcatgaatcccgataactatgctgagctggcctctcatattttccgcgttcagagcatctccaagacgcctcaggggaatagagacgtgcggatttacctgtttaaacagcagtatatctctggaagccaaaaggattccctccacctgaagggcattacacacagacagatctctagcgcgaaagaccttgccgagctggtcaagatccgcgtgaaccatctcgggcggattgtttccgtgggagaaaaatga

SEQ ID NO: 4535 - RNA, 4341 nt, synthetic construct
  misc_feature 1..4341: note = Cas9 variant
  source 1..4341: mol_type = other RNA
atggtgaagaacatcctgggcctcgacctggggaccaatagcgtcggatgggcccttattaaacaggatttcgagaacaagcaaggcgacatcctggggatgggatccagaattatccccatgtctcaggatgttctcggcgactttgggaaaggaaatagcatttcccagacagctgaacggacgaagtaccgctctgtgagacggctgcgcgagagattccttctgcggcgcgaaagactccaccgggtgctgaacgtcctggattttctccctgagcattatgccagccagatcgacttcaataaacgctttggcaagttcaaggaagagaccgagccgaaactggcgtactccaacgatggctttatcttcaagaaatcttttgaagagatgattagcgacttcaagacacaccaacccgaacttctggagaataacaaaaaggtgccttatgattggaccatctactatctcagaaataaggctctgtcccataaaattgagaaggaagaacttgcctggatcctgctcaactttaatcagaaacgggggtactatcagctgcgcggagaagaggaagaggagaaccccaataagctgattgagttctacagcctcaaaatcgttgacgtgctggccgatgagcctcagaagggcaaatctgacatttggtactcccttatcctggaaaacgggtggatctatagacggagctctaagattcccctcctggattggaagggaaaaacacgcgactttatcgtcaccacagaccttaatgatgacggctccgtgaagaccgataaagaggggaacgaaaagcggagcttcagagctcctggagagaacgactggacgctggttaaaaagaagaccgagcaagaaattgataattctgacaaaacagtgggcgcctacatctatgaggctctcctgcagaacccgaagcagaaaattaagggcaaactggtcagaaccatcgaacgcaagttctacaaggccgagctcaaacagatcctggaaaagcaaatggagtttcaccccgagcttcggcaggatgacctgtattccgattgcgtgagagaactctacaaaaataacgaggcgcatcagctgacacttagcaagaaagacttcgtgcacctgtttatggaagatattatcttctatcaacgccctctccggtcccagaagtctagcatttccaattgtaccctggagtttagaaagtacaaagacgagaacgggacggaacacatccagtacctgaaggccctccccaaaagcaatccttattaccaggagttccgcatttggcaatggatgtataacctgaatatctacaagaaagaagacgatacaaacgtcaccaaggagtttcttaattctaaagctgacttcgaatccctgtttgagttcctcaacaataagaaggaggttgatcagaaagccctgctgaagcattttaaaatcaacgacaagacacaccggtggaaatatgtggaagataagaagtacccctgcaatgagaccaaaaccatgattagcgaaagacttaagaaagtggagaacatctctgacgatttcctcacacgcgaaatggagcagaagatttggcatatcatttatagcgtcaacgacaaagtgaagtacgagaaggctctgaaatcctttgccgaaaagaataacctggatgagtctagcttcttcgaagcgtttaaaaagttcccgccttttaaatccgagtacggagccttcagcgaaaaggctatcaagaaactcctgccccttatgcggctgggcaagtattgggacgatgacgagattctcaaatactctgatatctattttaagaatatcgagtacctgctgggggttcttaaacagaaggacaaaaacatttccgacgataatagacaaaactggaataagagcatcaacaataagctccgcgaagaactggaaattttccagaacgccgagatcgagtcttttcagggactgcggctccacattgctcagtatatcctgtacggcagacactccgaagccgccatgcttgggaaatggaatagcgctgacgatctggaggagttcctcaaggagtttaaacaacattccctgcggaaccctatcgtggaacaggtcattacggagaccctgcgcgtggttaaggacatctgggtgaaatatggaaatggcgcgaaggatttctttaacgagattcacatcgaacttggcagagagatgaagctccccgccgaagaccggaaaaagattacaaatcagatctctgagaacgaaaacaccaatctgagaatcaaagctctgctcgccgagatgatggtcgatagctccgtggagaacgtccgccccttctctcctatgcagcaagaaattctgaagatctacgaggacggggtgcttaatagcgatattgaaatcgaggacgatattctgaaaatctccaagacagcccagccgagcccctctgacctcaagcggtacaaactgtggctggaacagaagtataaatccccttacaccggacaaatcattccccttaacaagctctttacgcctgagtatgagatcgaacatattatcccccagagcagatacttcgatgactctttctccaataaagttatttgtgaggctgccgtgaacaagctgaaggacaattttatcggcctggggttcattaaacagtttggaggcacaatcgtcgaatgcgggaacggcaagagcgtgaccgttctcaaagaggatcagtatgaggacttcgtgaagaaacactacgcgaataaccgctctaagagaaataagctgcttctggaagatatcccggagaaaatgattgaacggcaaatgaacgacacccgctatatcagcaagtacatttccggagtcctcagcaatatcgtgagaacagaggatggcaccgacgatggggtgaactctaaaaatattgttcctggaaacggcaagatcacaaacacgctgaaacaggactgggggctgaatgatatctggaacgaccttattctgccccggtttgaacgcatgaatcagctcaccaactccacagatttcaccgcttggaatgagaaccatcagaagtttctgcctacagtccccgtggagttcagcaaaggattttccaagaagagaatcgaccaccggcaccatgccctcgacgccctggtgattgcttgtgccaccaaagatcacgtcaatcttctgaacaatcaatctgctaagagcgacacgaaacgccatgatctcaagagaaaactgatgaagttcgaaaaggtggcctacaaccaccctcagaccggcgagcggatcgaacgcgaggttcccaaacagtttctgaagccgtgggaaacattcaccgtggaggcgaaaaatgggcttgagacaattatcgtctccttcaagcagaacctgagagtgatcaataaagccaccaaccactatgaaaagtacgttgagaaggacggcgctaaagtgaagggacgggtcgaacaagccggcacgaattgggctattagaaaacctatgcataaggagacagtgtctgggaaaatcgatctcccccgcattaaggttcccaagggaaaaatcctgaccgccacacggaagaacctcgacaccagctttgatctgaaaaccattggctccatcacagacacggggattcagaagatccttaaaaattatctgcagtacaaggataacaaccctgaactcgcgttctctccggagggaatcgaggacatgaataaaaacattgaaaagtttaatgatggcaaggtgcaccaacccatcattaaagtcagaatcttcgagctggggagcaagtttcctctgggccagtccggaaacaaaaaggacaaatatgtggaagccgctaagggcaccaatcttttctttgccgtgtacgaggataagaacgggaaacgcagctatgagacaattcccctgaatgaagtcatcgagcggcagaagcagggactcaccgttgtggacctgaaaggcgtgaacgacttctacctctctcctaatgatctggtctacgtgccctccgaagacgagcttgaaaacgttagcatgatcgattataataagctgtctaacgagaaagtgtacaaggtcgtgtcctttacagggaatcaaattttctttgttagacaggacgtggctaccagcatcgtcaacaaggccgagttctcttccctgaataaaatggaacgcgccattggaggcacgatgatcaaggaggtgtttgttaaaattaagatcgatcggctcgggaacatcagcaaagtgtga

SEQ ID NO: 4536 - RNA, 4347 nt, synthetic construct
  misc_feature 1..4347: note = Cas9 variant
  source 1..4347: mol_type = other RNA
atgaagcacatcctgggcctcgacctggggaccaacagcattggatgggccgtggtcaaagaggctcagaatgataacgaacaatccgagatcgttgacgtgggcgtgagagtcaatccccttacaacggatgaaaagaccaacttcgagaaagggaagcctatttctacaaatgccgaccggaccctgaaacgcagcgcgagacggaacctccagcgctacaagctgagacggaaggaacttatcgagctgctcaaagagcatcagctgatttccgaaaatacaatcctgaccgagaacggaaagggcacaacctttcagacgctcgaactgcgcgctaaatctgccaaggagaaaatcagccttggggagctggccagagtgttcctcaccattaataagaagcggggatataaatcctctcgcaaggctaaaaacggcgatgaaggccaactgatcgacgggatggagattgccaagagactttacgaagagaatctgacaaccggacagctcagcctgcagctgctcaaagaaggcaagaaatccctgccggattattaccggagcgaccttcagtttgagctggataaggtttggaacttccaaaagcagtctcactccgacatcctcacagatgagttttatgctcagctgaaagggaagggacagcgcgccaccagcgcgcttttcctggccaaataccaaatttatacggctgaaaataagggctctagagaggacaaaaagctccaggcctaccagtggcgggtggatgctctgtccaaggaactgacacgcgaggaactcgcctttgtcatcaccgagattaacaataacctgaacaatagctctgggtaccttggagcgatctccgacagaagcaaagagctgtatttcaacaatgaaacagtgggcgagtacctctggaagcaaatcgccgctaacccccataattccctgaaaaaccaggttttctatcggcaggactaccttgatgaatttgagcagatttggaagacccaatctgccttttatcctgaaatcctgaccgacgagctcaaaaaggagctgagagatgtggtcattttctaccagcgcaagctgaaaagccagaagtccctcgtgagcttttgcgagttcgagaataaagaaatcgagattaagaacgaggacggcacaacgaccaaaaaggtgatcgggctgaaggtcgctcccaaatcttcccctcttttccaggaatttaagatctggcaaaatctgaacaatgttctcattcggaaaaagggaagcaaaacaaagaaagtggccaagaaccagcaggccgtgctgttcgaggaagagaagaccatctctgaactggatcttgaggctaaacaggcgctctttaatgagctgaacctgaagggcaatctcaaagccgactattgtctggaaattcttgggtacagccccaaggagtgggaaatgaactactccatcctggagggaaacagaacaaataaagctctctatgaagcctacctgaagattaccgatctggagggctatgacgccaagaaccaccttaaagtcaagctcaataaagatgaggtggaactggacgatctgaaggttcctgcttctgagatcaaagacatggtgcaagccatcttcaaggaagcggggattaacacggacatcctccattttaatgctgagctggatggaaaggacttcgaaaaccaggccagctaccagctttggcatctgctctattcctacgagggcgatgacagcaaatctggcaatgagctgctgtataaacttctcgaaacaaaatttgggttcaagaaagagtacgcccagattctggctaacgtctccctgagcgatgactacggaaatctctctaccaaggccatgcgcgaaatcattacccacctgaagcaaggctttccgttcacagggcggaaagatagacccgacgagccttccgcttgcgagtttgccggatataagcacagcaaacactcccttaccaaggaagagaacgaaaaacgcgtgctgaaggattctctcgaggttctgaaaaagaatagcctgcggcagcccgtggtcgaaaagatccttaaccagatgattaatctcgtgaacgcgctgctgaaaaagtacagaacagagaatcctaacttcaaatttgacgagatccgcatcgaactcgcccgggagctgaagaaaaaggctgaagagagagccaacatgacggctaatattaacaaggccaaaaccgaacatgagaagatcattaaaatccttaagaatgagttcggcctgcccaacccgacacgcaatgatattatccggtatagactctacgaggaactgaaagacaacgggtataaggatctgtacaagggcgactatatccctcgggaaaaacttttctccaaggagattgacatcgaacacattatccccaaagcgcgcgtctttgatgactctttcagcaataagaccattacatacagaaaaaccaacctggagaagggagagcggacggcctacgattatatcgaatccctcggcgagaagcaactggaagagtttctcagcagaatcgagaatctgtacgaaattgggaaaccttctcgccttcacaaccggagaaatcccctgaagaaagtggaggaaaagggaatctccgacagcaaatataagaagctcctgaaaaaggagtctgaaattggcgatgggttcgttgagcgcgacctgagagagacccagtacatcgctaaaaaggccaaagaaattcttctgcagatcacacggtccgtgctcagcacctctggaggcatcacagatcgcctgagagaggactgggatctcattaacgtcatgaaggaactgaatcttcccaaatatcgggctctggggctcaccaagatggaggaccgcaagtacggccagcaagtggaagttatcacggattggacaaaaagaaacgacctgcggcatcacgccatggatgccctgaccgtggcttttacaaagcataatcacattcagtatcttaactacctgaacgcgcgcaaaaatgagaagcataaagagcacaacaatatcatggccattcagcagctcgaaaccatcaaggtcaccgacgagaacggaaatgaaaagagaattttcaaagctcctatgccgaactttcggcaagtggccaaggccttcctggagaatgtgctcatcagccacaaagctaagaacaaagttgtcacaaagaataagaacaaaatctccggcaataacaaggtgcaggaagtgctgacgccccgcgggcagcttcataaagagaccatttacggaaagtatcagtactatgtccaaaaagaggaaaagatcggcgggaagtttgacctggagacaattgaaaaagtggccaatcctctgtaccagagcctcctgaagaaaagacttgaggagaacggaggcgatcccaagaaagcgttcaccgggaaaaattctctggctaagaaccctatctatctcgacgaagcccagacagagcaactgcccgaaaaggttaagctcgtgtggctggaaaattcctttagcattcggaaagatatcaccccggaaaacttcaaggacgagaaacttatcgataagattctggacgagggcgtcaaaagaatcctgaaggaacgcctccagtcctttggaaacgatgccaagaaggctttctctgacctggagaagaatcctatttggcttaacaaagaaaagggcatcgccattaaacgggtgacgatcagcggggttgcgaatgctgagcccctgcacacaaagaaggatcatctcggaaaagaaatcctggacaaggagggcaaacctattcccgtggatttcatctccaccgggtctaaccaccacgtcgccgtgtacagagacgagaagggaaatctccaggaaaaagttgtgagcgtctttgaggccgtggtgcgcgctaaccagggcctgcctattatcgacaagacctataatcaataccttgggtgggagttcctgttttccatgaagcagaacgaaatgttcgtctttcccaatgaatctacaggcttcaacccgaatgatattgacctgctcgatcctaaaaacaagaaaatcattagccccaatctgtttcgggttcagaaacttgccaccggagactactggttcagacatcacctggagacaacggtggagaccaagtccgctacaaaggatatgacctataaacgcctcagcctgaaccatatcaagaatatcattaaggtgcggatcaaccacctcggcgacattgtctctgtgggggaatactga

SEQ ID NO: 4537 - RNA, 4353 nt, synthetic construct
  misc_feature 1..4353: note = Cas9 variant
  source 1..4353: mol_type = other RNA
atgaagcacatcctgggcctcgacctggggagcaactccattggatgggccttcgtgcagcaagattttgagaataaacagggcaagatcattgctaccgggtctagaatcattcccatggaccagggaatccttggcgatttcgaacgggggaacacagtcagccagacggccgagcgcaccacatacagaaatacccggcgcctgagagaacggcatctcctgcgcagagagcggcttcaccgcgttctgcatatcctcggatttctgcctccgcactatgactcccaaattgatttcacaaaaagatacggcaagtttatcgacaacgcggaacccaaaattgcttataataacggcaatttcatctttatgaactctttcaatgagatgattgaggattttaagaagtaccagcctcagctgttctataaaaagagcaacggggaagagtccaaaatcccctacgactggaccatttattacctccggaagaaagccctgtctcagaagatcacacaacaggaacttgcctggctgatcctccattttaatcagaagcgcggatactatcagctgagaggcgaggaggaaaccgagaaccctaataaagaagtggctttccacagccttgaggtggtcgatgtggaagccgaggctcccaacaagaaaggggagatttggtacacgatccggctggaaaatggatggatttatcgcagaacctccaagatccctctcgacgattggaaaggcaagacacgggactttattgttaccacagatctgaacgacgacgggaccatcaaactggataaggagggaaaggaaaaacgcagcttcagagccccggacgagaacgattggaatctcctgaagaaaaagacggaacacgacatcgatttctctggcaaaacagtgggcgcgtacatttatgaccatcttctgcaaaaccccaatcagaagatcaaggggaaactcgtccggaccattgagagaaagtactataaagatgagctgaaggccatccttgctaaacagattgccctgcaacctgaactctttacagagaccctgctggctgactgcatccgcgaactctaccggaagaacgagacccagcagcagaatctgctttccaaggatttcctgcacctctttgtggaagacatcattttctaccaaagacccctgcgcagcaaaaagtctacaatcgccaactgtacgcttgagaaacggtcctatattgataaggagaccaatgaaagaaaagacacacctatcaaggtttgcgctaagagcaacccctactatcaggagtttcgcgtgctgcagtggctccagaatctgcggatttacgaaatcgagaccgacagagaggtcacagccgagttcattgaaaccgctcaagataacgaagccctgtttaatttcctcatgtctcagaaagagatcgacaacgaatccctgcttaagtattttctgttcgctaaaaatccgcagatcaaggataaagtggccaagagcgagctcaaaaagtggctgacgacataccgctggaactatgtgtacgacgccgctgataattcctctaagaaataccctatgaacgagaccggatatgaactgcagcaataccttcagaaggtcgagggcctccccgcgaactttctgaccttcgacattacatatcggctgtggcatctcctgtacagcgttaaagataaggtggaatttgagaaagcccttaagaagttcgctcaggaatatcagctggacgaggcctccttcgtggatagctttaaaaatttcaagccttaccccaacgagtatgggtctttttccgaaaaagccatcaagaaactcctgcccctgatgagattcggaaatcactgggactttaaccggattgatgtcagcacccaaaagcgcatcgacgatcttattaatggcgtggctaacgacgagatcagaacaatcattcgggaaaaggccgagaaataccagctcaattctgaaacgtgtttccaggggctgcctctgtggctcgcgcaatacgttgtgtataacagacacgctgaggccgccgacatcgagaagtggaccagcgtcaatgatctggaagcgtaccttgaggactttaaacagcattccctgcgcaacccgattgtggaacaggttatcacagagaccctccgggtggtcagagatatttggcagcgctatggaggcggccaagccaatttctttgacgagatccacatcgaactggggagagagctgaagaaaacagctgaggaacggaagcagctttctaaccgcaatcaggaaaacgagaataccaacctcagaattaagaaactgctggccgagctcaaggaagatgcgagcatccagaacgtgcggccctactcccctgtccaacaggagctgcttaaaatttatgaagagggagtgttcagcgccacggacgaagttgaggaggatatccagaagattcgcaaaaaggctgaacccaccacacctgagatccagagatacaaactgtggctcgaacaaaagtataagtctccctacaccggcgaggtgatctccctgacaaaactgtttaccgaagagtacgagattgaacatatcattccgcagagccggtattacgacgattctctttccaataaggtcatctgcgagagcgccgtgaacaaactcaagacgaatcagctggggctggagttcattcaaaaccaccatggagaaaaagttcgcatcacagctaataaggaggtgaccatttttacagaggaacagtataaggagttcgtcaaaaagcactacgccaacaattccgcgaaacagcagaagctcctgcttaacgaaatccctgagaaaatggtggccagacaactgaatgacacccggtatatctctaagtacattagcgaaatcctctccaagattgtgcgctctgatgagaaagacgaaggcgttaacagcaagaatatcattccctgtaccgggaaaatcacaacggctctgaagcaggattggggcctgaacgacgtctggaatgagcttatcctgcctagattcgaacggatgaaccagctcacccagacacaactgtttacctcctataatgacagattccagaaaaacctccccacagtgcctattgagtacagccagggatttcagaagaagcgcatcgatcaccggcatcacgccatggacgctctggtgattgcctgcgccaccagagaacatatcaactacatgaataaccaacacgctcttgataaatctaaggacaaaaaggagaaacagcagtcccgcattgatctgcggacgatcctctgtgagaagaagaataacaattggcagttcaaaaagccctggagcacatttacccaagaagcgcaggaggccctggaacacatcgtcgtgtctttcaaacagaacctgagagttattaataaggctaccaactattacgagaaatgggaagagaagaatggcgtgcttgtcaaaaagaaggtgaaacaagaggggacaaactgggccatccgcaagccgctgcataaagaaaccgtttccggaaagattgtgctcgaccggaaaatcggcaaggataagattctgacagccacgagaaaaagcgtcgacatcacctttacagagaagattatctctagcatcaccgatacagggattcagaaaatcctcctgaattatcttaagtacaaaggatcccctgaagtggctttcagcgccgagggcctggaggaactcaacaagaatattgcgcagtataacgacgggaagaaacaccagcccatctacaaggttcgcatttttgaggaaggctctaaattccccctgggagagaccggcgctaaggccacgaaatatgtggaagccgctaaggggaccaatctgtttttcggagtctaccaaggcaaggggaaacggacatacgccaccatccctcttaacgaggtgatcgagagacagaagcagggactgccgtccgtgcccgaacggaatgagaaaggcgaacctctcctgttcagcctctcccccaacgatctggtctatgttcctatggagggggaaattgcggagacaatcgactttaacaatctttctaaggagcagaaagaacgcatttacaagaccgtgagcttcacaggcaaccaatgctttttcgtgcaggaggctgtcgccacccccatcgtgaataaaattgaatattcccctctgaacaagatggagagagacatcctgggaacgatgatcaaggaagtttgtattaaactcaaggtggatcggctgggcaatatcacaaaagcctga

SEQ ID NO: 4538 - RNA, 4353 nt, synthetic construct
  misc_feature 1..4353: note = Cas9 variant
  source 1..4353: mol_type = other RNA
atgaagagaatcctgggcctcgacctggggagcaactccattggatgggccttcgtggagcaggattttgaaaataaacaaggcaagatcattgctaccgggtctcggatcattcccatggaccagggaatccttggcgatttcgagaaagggaacacagtcagccagacggccgaacgcaccacatacagatccatgcggcgcctgagagagcggcacctcctgcgcagagaacggcttcatcgcgttctgcacatcctcggatttctgcctccgcattatgacgcgcagattgatttcaccaagagatacggcaaatttatcgacaatgctgagcccaagattgcctataacaatggcaacttcatctttatgaatagcttcaacgagatgattgaagattttaagaaataccaacctcagctgttctataagaaaagcaatggggaggaatccaagatcccctacgactggacaatttattacctccggaaaaaggtgctgtctcagaagatcacccagcaagagcttgcctggctgatcctccactttaaccagaaacgcggatactatcagctgagaggcgaggaagagacagaaaatcctaacaaggaggtggctttccatagccttaaagtcgtggatgttgaagccgaggctcccaataagaaaggggagatttggtacaccatccggctggaaaacggatggatttatcgcagaacgtccaagatccctctcgacgattggaaaggcaagacccgggactttattgtgacaaccgatctgaatgacgacgggacaatcaaggtcgataaagagggaaaggaaaaacgcagcttcagagccccggacgagaacgattggaacctgctcaagaaaaagaccgaacacgacatcgatttctctggcaagacggtgggcgcgtacatttatgaccatctgcttcagaatcccaaccagaaaatcaaggggaaactggttcggacaattgagagaaagtactataaagatgagctcaaggccatcctggctaagcagattgcccttcagcctgaactgtttaccgagacactcctggctgactgcatccgcgaactgtaccggaaaaatgagacccaacagcagaacctcctgtccaaggatttccttcacctgtttgtggaagacatcattttctaccagagacccctccgcagcaaaaagtctaccatcgccaattgtacactggagaaacggtcctatattgataaggagacgaacgaaagaaaggacacctttatcaaagtctgcgccaagagcaatccttactatcaagagttccgcgtgcttcagtggctgcagaacctccggatttacgaaatcgagacagacagagaggtgaccgcggaatttattgagacagctgaagattatgaggccctgttcaattttctgatgtctcagaaagaaatcgacaacgagggactcctgaagtacttcctttttgctaaaaatccccaaatcaaggataaagtcgccaagtccgagctgaagaaatggctcaccacgtatcgctggaactacgtttacgacgccgctgataatagctccaagaaatatccgatgaacgaaacaggctacgacctgcagcggtatctgcagaaggtggaggggcttcctgcgaatttcctcacctttgatattacctacagactgtggcatctgctctattctgtgaaagacaaggtcgagttcgaaaaggccctgaaaaagttcgctcaggaataccaacttgatgaggccagctttgtggactccttcaaaaactttaagccctatcctaacgagtacggatctttctctgaaaaagccatcaagaagctgctccccctgatgcggtttggcaatcactgggatttcaaccgcattgacgtttccacacagaaaagaatcgatgacctgattaatggggtggctaacgacgagatccggaccatcattagagaaaaggccgagaaataccagcttaatagcgaatcttgttttcagggactccccctgtggctggcgcaatatgtcgtgtacaaccgccacgctgaggccacagatatcgagaagtggacgagcgtttccgacctcgaaacctatctggaggatttcaaacagcactctcttcggaatcctattgtggaacaggtcgtgacagagaccctgagagtcgtgcgcgacatctggcaacagtacggcggcgggcaggccaactttttcgatgagattcatatcgaactcggaagagagctgaagaagacagctgaggaacggaaacagctgagcaatcgcaaccaagaaaatgagaacaccaatcttagaatcaagaaactcctggccgagctgaaggaagacgcttccattcagaacgttcggccgtatagccccgtgcagcaggagctcctgaaaatctacgaagagggcgtcttttcttccacggatcaagtggaagaggacattcagaagatccgcaaaaaggccgagcctaccacacccgaaattcagagatataagctgtggctggagcagaaatacaagagcccttacaccggggaagttatctctctcacaaaactgttcaccgaggaatatgagatcgagcacattatcccccaatcccggtactatgatgacagcctgtccaataaggtgatttgcgaatctgcggtcaacaaacttaagacgaaccagctcggactggagtttatccagaatcatcacggcgaaaaggtgcgcattacagggaacaaagaggtgaccatcttcacagaggaacaatacaaggagttcgttaaaaagcattatgccaataacagcgctaaacagcagaagctgctcctgaatgaaattccggagaagatggtcgccagacagcttaacgatacccggtacatctccaaatatatctctgaaattctgagcaagatcgtgcgctccgacgagaaagatgagggcgtgaatagcaagaacgtcattccttgtaccggaaaaatcacaacggctctcaagcaagactggggcctgaatgacgtgtggaacgaactgattcttcccagatttgagcggatgaatcagctgacccagacacaactcttcacctcttacaacgatagatttcaaaagaatctgcctacagttcccatcgaatactcccaggggttccagaaaaagcgcatcgaccaccggcaccatgccatggatgcgctcgtgattgcctgcgctaccagagagcacatcaactatatgaataaccagcatgccctggacaaaaacaaggataaaaaggaaaagcaacagagccgcattgaccttcggacgatcctgtgtgagaaaaagaataacaattggcagtttaaaaagccttggtctacattcacccaggagaccaaagaagctctcgagcacattgtcgtgtcctttaagcaaaacctgagagttatcaataaagccacaaactactatgaaaagtgggaggaaaagaatggagtgctggtcaaaaagaaagtgaagcaggagggcaccaactgggccatccgcaaaccccttcacaaggagacagttagcgggaagattgtgctggatcggaaaatcggaaaggacaaaattctcacggctaccagaaaggaagtcgatatcacattcaccgagaaaattatctctagcattacagacaccggcatccagaagatcctgctcaattacctgaactataaggggtccccggaagtggcgtttagcgccgagggccttgaggaactgaataaaaacattgctcaatacaatgatggaaagaaacatcagcctatctataaggtgcgcattttcgaggaaggctctaaatttcccctcggggagacgggagccaaggccaccaagttcgtcgaagctgccaaaggcacaaacctgttctttggggtttaccagggaaaggagaaacggtcctacgcgaccatccccctgaatgaggtgattgaaagacagaagcaaggccttcctagcgtgccggagcggaacgaaaaaggggagccccttctcttctccctgtctcctaatgacctcgtctatgtgcccatggaaggcgagatcgctgagacaatcgactttaacaacctgagcaaggaacagaaagagcgcatttacaagaccgtttccttcacaggaaatcagtgctttttcgtgcaggaagccgtcgccacccctatcgtgaacaagatggagtattctccccttaataaaatggaaagagatattctgggcacgatgatcaaggaggtttgtattaaactgaaggtggaccggctcgggaacatcacaaaagcttga

SEQ ID NO: 4539 - RNA, 4353 nt, synthetic construct
  misc_feature 1..4353: note = Cas9 variant
  source 1..4353: mol_type = other RNA
atgaagcacatcctgggcctcgacctggggagcaactccattggatgggccttcgtgcagcaagattttgagaataaacagggcaagatcattgctgccgggtctagaatcattcccatggaccagaaaatgcttagcaacttcgaagagggaaccacagtctcccagacggcggaacggaccacataccgctctatgagacggctgcgcgagagacatctcctgcggcgcgaaagacttcaccgggttctgcatatcctcggctttctgcctccgcactatgatgctcaaatcgacttcaccaagcgctacgggaaatttattgataatgccgagcccaagatcgcctataacaatggaaacttcatttttatgaatagcttcaacgagatgatcgaagactttaaggagcatcagcctcagctgttctacaaaaagtccaatggcgaagagtctaaaattccctatgattggacaatctactatctcagaaagaaagctctgagccagaagattacccaacaggagcttgcctggctgatcctccactttaaccagaagcggggctactaccagctgcgcggggaagaggaaacagagaatcctaacaaagaagtggctttccactcccttaaggtggtcgacgtggaggccgaggcgcccaataaaaagggagaaatctggtataccattagactggagaacggctggatctaccggcgcacgagcaaaattcctctcgatgactggaaggggaaaaccagagattttatcgttacaaccgacctgaatgatgacggaacaattaagctggacaaggaaggcaaagagaagcggtctttcagagccccggatgaaaacgactggaacctcctgaaaaagaaaaccgagcatgatatcgacttctccgggaagcccgtgggaacgtatatctacgatcaccttctgcaaaatcctaaccagaagattaaaggcaagctcgtccgcacaatcgagcggaaatattacaaggacgaactgaaagctattcttgccaagcagatcgctctgcaacccgagctctttaccgaaacactgctggccgattgcattagagagctctatcgcaagaatgaaacccagcagcagaacctgcttagcaaagacttcctgcatctctttgtggaggatatcatcttctaccaacggcctctgagatctaagaaatccaccattgcgaattgtacacttgagaagcgcagctacatcgacaaagaaacgaacgagcggaaggatacccccattaaggtttgctctaaatccaatccgtattaccaggaatttagagtgctgcagtggctccagaacctgcgcatctatgagattgagacagaccgggaagtcaccgccgagttcatcgaaacagctcaagactacgaggccctgtttaatttcctcatgagccagaaggaaattgataacgagtccctgcttaaatattttctgttcgctaagaatcctcagatcaaagacaagaccgccaaaatcgagctcaagaagtggattacgacatacagatggaactatgtgtacgatgtggccgacaattctagcaaaaagtaccccatgaacgaaaccggctatgatctgcagcgctacatgcaaaaagtcgaggggctgcctaccaattttcttacattcgacaccacatatcggctctggcaccttctgtactccgttaaggataaagtggaatttgagaaggctctcaagaaattcgcgaagaaaaagcagctggacaaaacgagcttcgtggattcttttaagaacttcaagccctatcccaacgaatacggatcctttagcgagaaagccatcaagaaacttctgcctctcatgagattcggcaatcactgggactttaaccggattgatgtctctacccagaagcgcatcgacgatctgattaatggggtggctaacgaggacatcagaacaatcattcgggaaaaagccgagaagtatcagctgaatagcgaaacctgtttccaagaccttccgctctggctggcccagtacgttgtgtacaacagacatgctgaggccacagatatcgaaaagtggacctccgtctctgacctggaggcgtatctcgaggattttaaacagcacagcctgcgcaatcccattgtggaacaagttgtgacggagacccttcgggtcgtgagagacatctggcagcagtacggaggcgggcaggctaacttctttgatgaaattcatatcgagctgggacgcgagctcaagaaaacagccgaagagagaaagcaactgtccgacaaaaatcaggaaaacgagaataccaacctgcggatcaagaaacttctcgccgaactgaaggaggatgctagcattcagaatgtccgcccttattctctggtgcagcaagagctcctgaagatctacgaagagggcgttttctccagcacagacgaaattgaggaagatatccagaaaattagaaagaaagtggagcccaccacgcctgagatccagcggtataagctgtggctggaacagaaatacaagtctccctatacaggcgaggtcatctccctcaccaagctgtttacagaagagtacgaaattgagcacatcattccgcaaagccgctactatgacgattccctgtctaacaaagtgatctgcgagagcgccgttaataaacttaaaaccaaccagctcgggctggagttcattcagaaccatcacggagaaaaggtgagaatcaccgctaataaagaagtcacaatttttacggaggagcaatacaaggagttcgtgaagaaacactatgccaacaattccgcgaagcagcagaaactgctcctgaacgaaatccctgaaaagatggtggcccggcagcttaatgacacccgctacatctctaaatatattagcgagatcctgtccaagattgttagaagcgatgaaaaggacgagggcgtcaactctaaaaatatcattccctgtacagggaagatcaccacagctctcaaacaagactggggactgaacgatgtgtggaatgagctgatccttcctcggttcgaacgcatgaaccagctgacccagacgcagctctttacatcctacaatgacagactgcaaaagaacctccccaccgtgcctattgagtatagccagggcttccagaaaaagcggatcgatcatagacaccatgccatggacgctctggtcattgcctgcgcgacccgcgaacacatcaattacatgaacaatcagcacgcccttgataagtctaaagacaagaaagagaagcaacagtcccggattgatctgagaacaatcctctgtgaaaagaagaacaacaattggcagtttaaaaagccctggcgcaccttcacacaggaggctaaggaggccctggaacatatcgtggttagctttaaacaaaacctgcgggtgattaataaggctacgaactactatgagaaatgggaagagaagaatggggtccttgtgaaaaagaaggttaaacaggaaggcaccaactgggccatcagaaagccgctgcacgaggagacattctctggaaaaattagcctcaatcgcgaaaaggtgggcaaagggaacatcctgaccgccacacggaaggctgtcgactccagctttgatgtgaagaaaatttctaagatcaccgacacgggcattcagaaaatcctcctgaattaccttaagtataaaggatcccctgaggttgcgttcagcgccgaagggctggaggagctcaacaagaatatcgctcaatacaacaatggaaagaaacatcagcccatttataaggtgagaatctacgaaaaaggctccgggcgctttgtcctgggcgagaagggaaccaaatctaagaaatatgtgcagggcgcccccaacctgtacttcggggtgtaccagggaaaggaaaagcggacatatgccaccattcctcttaatgaggtcatcgaaagacaaaaacagggcctgccgagcgttcccgagcggaacgagaagggggaacctctcctgttttccctctctcccaatgatctggtgtacgtgcctatggagggagaagctacagagaccattaacttcaacaatcttaacaaagaacagaaggagcgcatctataaaacagtcagcttcaccggcaatcagtgctttttcgtgcaagaggccgttgcgtcccccatcgtgaacaagatggaatactctcctctgaataagatggagagaagcattgtcgggatcatgattaaagaagtgtgtatcaagctgaaagttgaccggctcggcaacattacgaaggcttga

SEQ ID NO: 4540 - RNA, 4362 nt, synthetic construct
  misc_feature 1..4362: note = Cas9 variant
  source 1..4362: mol_type = other RNA
atgaagaccgtgctgggcctcgacctggggacaaacagcatcggatgggcccttattcagcacgatttcgactccaaaaagggcgagatcctggggatgggatctagaattatccccatgagccaagatattctcggcgaatttgggaaaggaaattccgtctctcagacggctgaccggaccaagttccgcagcgccagacggctgcgcgagagacatcttctgcggcgcgaaagactccaccgggttctgaacatcctgggctttctccctcgccattacgcggctgatatcgacttcgagaaaagactgggccagtttttcgaagggaaggagccgaaacttgcctatgataataaccagtttattttcacaaagtcctttggaaagatgctggccgacttccggcaacaccagcccgattttctcaaagacgagaagtctaatgatctgcttatcccttacgactggagcatttattacctgcgcaaagaagctctcaccaagaagatcgagaaagaagaactggcctggattatcctgaacttcaatcagaagagaggctattaccagctccggggagaggaagaggaagagaacctgaataaacttgtggaatttcattccctgaagattatcgatgtggtcgctgacgagaaactcaacaataagggagagacatggtatagcctgcttctggaaaacggctggacctaccgcagatcttccaaagtgcccctcttcgactggaaggagaaggttcgggatttcatcgtgacaaccgacattaatgatgacgggagcgtcaaaacggataaggaaggaaacgagaaaagatcttttcgcgccccttccgacgatgactggaccctgctgaagaaaaagacagaacaagatatcgacaagagccggaaacccattggcgcgtacatctatgatgccattctcaagaatcctaaacagaagatcaacggcaaactggtgagaaccgttgagcgcaagttctacaaggaggaacttaaactgatcctccagaagcagaaagagtttcacccggaactgcaatctacagacctttataacgagtgcattcgggaactgtacaagaataacgacgctcaccagctccagctgaataaaaaggatttcgtgcatctgtttctcgaggacatcattttctatcaaagacccctgcgctcccaaaagagctccgtcgggaactgtcctcttgagtttcggaaattcaaggattctgaaggaatcgagaaagtggaatacctgaagaccattcccaaaagcaatccttattttcaggagttcagaatctggcagtggatgtacaacctctccatctacaagaaagacgatgacgagaatgtgacgcgcgattttctgaagacaattgaagactgggaggatctgttcgaatttcttaaccaccggaaggacatcgagcaggaaaccctcctgaaattcctgctcggcaagaatggggtcaaaggaaaggccctgaaagttgaggctggcaagttcagatggaactatgtgagcgataagatttacccctgcaatgagacaaaagcccttatcatttctaagctggaaaaagtgaagggggtcgaggaaaaatttctcaccgaggaaatcgagtataagctgtggcatctgatttactccgtgaccgacaaggttgagtatgaaaaagcgcttaaggccttcgctggaaaacagaagctcgatctggtgagctttgtcgactctttcaaacgctttccgcctttcaagaacgagtacggcgcctatagcgaaaaggctatcaaaaagatcctgcccctcctgcggacaggcaaatcctggaattggatggccattgactctaaggtgagagatcggatcaacaaaattatcacgggggagtttgacgaagagattaagaataaagttcgcgagaaggccgaaaagcacagccttaaaaaggagaacgatttccagggactgcctctctggctggctcagtacgtggtctacggcagacactccgaagcgagcttttctgggaaatggaactccgtggacgatctgaagaaatatcttgaggagttcaagcaacatagcctccggaatcccatcgtcgaacaggtgctgaccgagacactgagagttgtggccgacatctggcagttttacggaaagggcgaaaaagatttcttttctgagattcacatcgaactcgggcgcgagatgaagaacaccgctgaggaccggaaagaaatgtccgccattatccaggccaatgagacaaccaacctgagaattaaggcccttctgaatgaactcctgcaagataaaaaggtcgagaacgtgcgcccctatagcccttcccagcaggaaatcctgaagatctacgaggacggcgttctttctagcgatattgagatcccggacgatattcagaaaatctccaaggctgcgcaacccacgaaatctgaactccagagatataagctgtggctggagcagaaataccggagcccttatacaggagctatgattcccctcggcaagctgttcacctccgaatacgagatcgaacatatcattcctcaaagcctttacttcgacgactctttttccaataaggtgatctgtgagagcgccgtcaacaaactgaaggattctcgcctcgggatggagttcattaaagaatgccacggaatggtggtggagaccggctttgggaagtccgttacagtcttcgaagaggagacctatagagactttgtggtgcagaattacagcaaaaaccattctaaaaagagcaagctgctgcttgaagagatccccgaaaagatgattgagcggcagatgaatgatacacgctatatctccaaattcattagctctgtcctgtccaacatcgtgagagaagaggttaatgacgatggagtgaacagcaagaatatcgtcccgggcaacgggaaaattacgacccagctcaagcaagactggggcctgaacgatatctggaatgagctcattctgcctcggtttgaacgccttaacgtgctgacagactccaaacacttcaccgcctggtctgagaatcaccagagactcctgcccacagttcctatcggactgagcaagggcttttccaagaaacggattgatcatcgccaccatgctcttgacgccctggtgatcgcttgtgcctctagaaaccacatcaatttcctcaacaatgcgcacgccattgataagaaaaagaacagcgaagagaaacagaagtttcggcatgacctgaaggctatcctctgcgacaaaaagtactccgataaatctgaaaagaattatagatggattttcaaaaagccctgggacaacttcaccatcgatagcaagaatgccctggacaaaattatcgtctcctttaagcagaaccttcgcatcattaataaagctacgaaccggtacgagaagtgggtggatagagacgggatcaaagttaaggagtggcacaagcaagaaggaattaattgggccacccgcaaacctctgcataaggatacagtgagcggcaaagtcgacctcaagcgggtgaccgtgcccgaggggaaaatcctgacagcgaccagaaagtctctggatacgtccttcgaccttaaagtcattgaaagcatcacagataccgggattcagaagatcctgaagaactatctcacatctaaatccaacaatccggagctggcctttagctctgaaggcgttgaggacatgaacaagaatatccgcaaatacaacgatgggaagctccaccagcctatttacaaagtgcggatcttcgagctgggctccaagtttccccttggacagttcggcaataagaaatttaagtatgtggaaaccgctaaagggaccaacctgttctttgccgtctacgaggacgaaaataagaacagaaattatgagacaattcccctgaacgtggttatcgagcgccaaaaacagggactcagctccgtgcctattaagagcgaaaagggccataaactgcttttctacctgtctccgaatgacatcgtctatgtgcccgggagcaacgaggaattttccatcgatcggctctacagattcacggactctagcgataagaccgctaattttattcctctgtccgtttctagcctcatcttctcctctaacaaaaatgagcagaagaaaattggaatcagctatcccattcaagacgagttcggcctggggtcccctcagagcaagaaccagaagtctatcgatggcatcatgattaaagagaagtgtgtgaaagtcaatatcgaccggcttggacgcgtgtccttttga

SEQ ID NO: 4541 - RNA, 4368 nt, synthetic construct
  misc_feature 1..4368: note = Cas9 variant
  source 1..4368: mol_type = other RNA
atggccaagatcctgggcctcgacctggggaccaacagcattggatgggctgtggtcgaggatcagaataacaaaacaacgcttatcgacaagggcgttagaattttctccgaaggggtgaaaatcgagaagggaattgaaaaatctaaggccgcggagcggaccgattttcgcagcgctagaaagatcaaattccggcgcagactgcggaagcaagaaacactcaaagtgctgatcgagaataacatgtgcccccttaccattgaggaatggacaaagtggaaaaaggacaagaaagagtaccctaagaatccggattttatcaactggctgaaaaccgacgaactcaagaatattaacccctatttctttcgcgataaagcctccagaacagagctgcctctgatgcagaccggccgggccctctaccacctggctcagcgcagagggttcctttctaatcggctggaccagggaagcgatggctttacggagcaaatccgcctcgacctgattaagaaaatcgaatgtgagaccgataagacagaacttctgacctccgtccagtctattatcgacacatatagcgaggaagaggataaggacgccaaaaagctcctgaaaggcgtggagaagctgtgcaaaatcaacaatgaactccccattaccgagttcaaggaaaagctgatcaactaccttaataaagctgacaacctgggggccgttaagaaaggaattgcggatgtgtccaagaaaatcacggagacaggctgtgaaaccctcgggcagtatttttacaagctgtatcagaatcaaagcaagattagaaaagtctacacagcccggaccgagcattactatcacgagttccttaagatctgcgaaacccagaacatctgtgaccagctgaaacataagctcgataaagctattttctaccagcgccctctgaagtctcaaaagggactgatcggcaaatgcgtgttcgagaagaacaaaacaagatgtgccgtttcccaccccgcttatgaagagtaccgggccctccagtttattaatagcatcaaggtgtctgaaacgaaagacgggaagaaagatttcctgtccttcgacgagagaaagaagatttggcctaaatttatccgcaagagcaaaccgaacttcgattttaaggagatcgcggaaacccttgacaaaaagggactgtctcggtattacaattatacaggccatacctccgtcagcggctgccccacaattgcccagctcaccaacatcttcggggagaattggcaagaaacgctgtttgagaagtacacaaacaaacagaataccaagggacttaaaaccattgatgaggtggtgacagacatctggcacgtcctgttcacctttgataaggacgaaaagattatcgagttcggcaaacagaagctcgggctgaacgaagttctggctaaaaagtttggagccattaatctcaaaaaggactacgcttccctgtctcttaaagccatcaacaagatcctgccttatctcagagagggcctgatttacagctatgccgtgttcctggctaatatcgaaaacgtggtcggggaggagatttggaagaatgatgaaaacaaaaatcttatcaagaaagagctccatctgctgattgacaactttaacgaaatcaagggactcgaggcggtggttaatgatttcatcgccgactttaaaaaggaatacaacaatgctcacaaagattatgtgctggacgagcaggataagaagattcttctggagaaaatcgaatccaactacggcaagaataaattcgagagcctcgaacccgacaagaaaacagagattatcaactctacggaaaagatggtcgccgagcaactgcgcaagcagcggggcgagttcattaaacctaagagactggatgagaaaatctccgaatttcttatcaataacttcaatgtgaccaagaaaagcattgcccgcctctatcacccctctgacgttgaaatctttaagacagctagccggaactccgaggggctgctgctcctgggatctccgattgtgagctccatcaagaatcctatggccatgagagcgatgcatcagcttcgcaaactggtcaacaccctcattaaggagaatatcatcgatgaagagacaaaaattaacatcgaactggctcgggagctgaatgacgccaacaagagagccgctattaaaaagtggcaggatgaacgccaaaaggcccgggaggagtacaaaaagagcatcaaagaacttttcaaggctgagtgtggcaaagacattgaaccctctgactccgagatcctcaagtacgaactgtgggaggagcagcagcacatttgcatctataccgggaagacgatcaacatttgtgattttatcggagccaatcctaacttcgacattgaacacaccatccccaaaagcctgtgctttgataattctaacgagaatctcacactgtgcgacattcagtacaacagagatgtgaagcggaataaaatccccaccgaactttccgactataacagcatcaagcctcgcctggataaatggctcgtcttcattgacgattacgagaagctgtataatacacggaaaaaggcgaagggcatcgaaaccaaagagcaaaaggacaaaagaattaaggagaaacattactataagctgcaccttgattactggaaggggaaatacaagagatttatcatggtggacgttccgtccggcttcaaaaactctcagattgtggatacgggaatcatcacaaagtatgccattagctacatgaaatccatctttcccaaggtctattctgtgaagggcaatattgttgctgaatttcgcaaaatctgggggctccagaacgactacgagaagaaagaacgggtgaatcatgtccaccattgtattgacgccatcaccattgcttgcatgagcaagcagaaatatgatacactggccaagatctaccacgaggacgaggcgggatttcacaagatcaaaaaggaaacccaactggtgtccaaaccttggaccagcttcacaatggatgtgctcaacattgagaaggaaatcttcgtttctcatcacacgcccgacaatatgaaaaagcagtccaaaaaggtcgtgagagagcgcggcattatcgcccctaaggtgatttatgaaaccgatgctaacaacaatacactgagagacaaatacgggaagaaaatcgtcaaggagtacatccttctgaaagatgtgaacggaaatctcattcccatcaagggcaagcggctgaccccgagcgacattatcaacaaagttgatgggattgactatttttctctgatcatcaatgataagattcagtactatgagttcgccaaatccaagaaaacaggcaagatcatttacaagaaagaacctatctatcttcaaggagacaccgtgcgcggcagcctgcatctcgacacgttttacggggctattgccaaggatatcaacggaaatattatcacaaacaccaatggcaaaatcgcccccaactatgtcattagaaaggagctgtctaaactcaaggaaaccgacatcgagaatattgtggatcctgttgtgcgggggaagatcattgaagctaaaaagaacaaactgatcacattcaataagagcggagcggtcatcaaaaccacaatttggatgaaggagaaccagatccccattaataaagtgcgcgtttactccagccttaagaaccctctgcccgactttaagaaacacagagatctctctcacctgacgtacaagcagcagtataatgtgtccaacgaggaaaactactgtctggccatctatgagggcaaaaataagaaagggaacgtctgccggacctgtgaacttgtgaatatgattgacgctggcaactactatcgcctgagcaataagaactggaagcaacagtacccgatcgtgcctgagaaagattccgtcacaaattattctctcaagaccatcattacaaaaggactgatggttctcctgtacgaaaagagccccgaggagatctgggaacttacctacaaccagcagatggagagactgtatgaaattacgcaactcgacaccgagaaatccgccgagatcaagctgctgttccatcaggaagcccgggagaagaaagtgattacagaatacatgggccttaagaccgggatgaaaggaggcaagaatatcgggaaacacaaggagtttccctggattaaggtgggacctaactctttcgatgctctgatcgaaggcatcgactttaaactcacaccgaccgggaagattatcaaactgtga

SEQ ID NO: 4542 - RNA, 4374 nt, synthetic construct
  misc_feature 1..4374: note = Cas9 variant
  source 1..4374: mol_type = other RNA
atgaagaccatcctgggcctcgacctggggacaaacagcattggatgggccaaagtgtccgtcgatgactacggcaattatcttcacgatatcaagctggggtctagaattatccccatgagccaggacgttctcggaaacttcgattccggcgtgacggtgtctcaaaccgctcagcggacagagtttcgcagcaaaagacggctggtccagcgcaatcttcagagacgggaacgcctgcatagagtgctccacgttctggacttcctgcctgcccattacgatgcggctattgggtgggaccggaccgaggccgtgacatatggaaagtttctcaaccacgccgaaccgaaactggcttgggaggaacttggcaatggcaagcgcagattcctgtttatggattccttccatgagatggtcgccgactttgctcggtgccaacccgccctcgtggcggatgggaagaaaatccctctggactggaccatctactatcttcgcaagaaagccctgacacaggctattaccaaggaggaactcgcctggatcctgctgaacttcaatcagaaaagaggatactatcagctccggggcgaggaagaggaggaaaaccccacgaagcaagaggaatactacgagctgaaggttgtgtctgtcgaagctaccgatagccgcaaagggaatgacacatggtataacgtgcaccttgagaatggatggatttacagacggtccagcaagatctctctggacgattgggtgggcaaagtcaagcagtttattgttaccacagagtatgaaaaagacggggccaccctcaagacggataaagagggatacgtgaagagatccttccgcgcgcctaacgaaaatgactggggcctgcggaagaaaagaacagagacccttctggaaatgagcggcaagacagtgggggcctttatctatgatcacctcctgcaggagcccgctgacaaaattcgcggaaacttcatccggaccatcgagagacattactataaggccgaactggaggctattctcgccgaacagtgtaaataccacatcgagctgcgcgataaggaaatgcttgaggcctgcgctcgggagctgtacctcaataacctgcctcatcaaagatctcttatgaagaaagacatgacctatctgctcctgtacgatctgatcttttatcagcgcccgctcaagtccaaaaaggcgctgattgccaactgtccctacgaatattacgagtatgtcgacaaagaaacaggcgagattaagcggcagaatatcaagtgcatcgctaaaagcaacccttacttccaagagttcagactttggcagtttgtgctgaatctccgcctgttcgatcgggttgaagacaaggaggtgacggccaactacctgcccaccgccgacgatcacgctagactttttacatatctcaatgaccggaaagaaattaaccaggagaccctgctgaaggattacttcaaactcaagaaggtcaaaatcgggaatgaaaaggagtatcctattcgctggaactacatcgaggacaaagaaaagaaatatccctgtaatgagacaagatacgaactgcttatggccctggatcgggcgggaattgagcacaagtggctcgacgataacaatctggaatatagactgtggcatcttctctactctgtggaggttaaatccgagagcgaaaccgctctgcgcaagctgaagaacgacgatgcctttgtgaatagcttcctcaaagtcaagccgtttaaaaaggagtacggcgcctattctgaaaaagctatcaagcggctgcttgccgtgatgagaaaggggttcctgtggaacgagcaggacatctgcgatgaaacgcgcaaaagaattgagatcattatcaagggagacgtcgatgagaaagtgaaggaacggatgggccacgctgcctacagctttgaccgcgtttccgacttccaaggcctccctgagtggctggcgtgttatgtggtctacgggagacatagcgaagccatggatattcagcactgggactctcccgagcggctgatggcttatatcaataactttaaacagtactcccttcgcaaccctattgtggagcagtgcatcctcgaaacactgagaaccgttcatgatatctggaaggagaccggacaaattgacgaaatccacgtggagctgggccgggaaatgaagtccacatctgaggagcgcgccagacggacccagaatgtcctccgcaacgaaaatacaaacctgagaattaaaagccttctgatcgagctcaagaatgatacggacatttgtaacgtgcacccctattcccccatgcagcaggaaatcctgcggatctacgaggaaggggctctgcaagagcttaatagagaggatgaagacttcgaggaaatttctaaaatcagccagatgtcccagcctagcggaaaggagctcaaccgctacaaactgtggctggaacagaagtatcggtctccgtacaccggcaaggccatttccctcgcgaaactgtttacacccgcctatcaaatcgagcatgtgattcctcagagcagatacttcgatgactctttcaccaataaggttatctgcgaggctgaagtcaacacacttaaatccaatctgctcgggtatgagtttatcaagaaacacggcggagaaattatccattgtaccacgctgggcgatgtgcgcattttcagcgagtccgagtacaaggcctttgtgatggaccactatgctaacaataaatctaagaaggataaactgcttatggaagacatcccccaggagttcctgagccggcaaatgaacgactccagatacatttctaaggtcgtgaaaaccctcctgagcaatatcgttcgcatggccgatgaatccgaggccacaagcaagtctgtgatcgtctgcaccgggggagtgacagaccggctcaaaaaggattggggcctgaacgacgtttggaactccattgtgtacagcagatttgaacgccttaatcggctgaccgggacggaggctttcggacactgggagaacaaggatggcaaaagagtctttcagacatctatgcctctcgaactgcagcgggggttccgcaagaaaagaatcgaccatcggcaccatgcgatggatgccctggtgattgcttgcgcctcccgcaatatcgttaactatcttaataacgagagcgccaataaccccaagaaaagagaagacctgcggagacagctctgtgataagaatcgcgtgattcggaagccgtgggagacctttacacaagacgcttacaacgccctggaaaatgtcgtggtgtctttcaaaaactatgtcagagttatcaataaggcgaccaaccgctacgagcactatgatgagaatggcaaaaagcggtttgtgcagcagaaaggaagcgaactctgggctattagaaagcctatgcataaggagacctactatggccacgtgaacctgcgccggaaagaacttgtcacactgcagaaggccctcgacgacatcccctccatctgcgataaaaagctgagagactacattagcgccctggtggagaaacacttcaacaagcgccaacttctggctcattttaagtctacggattactattggcagaaacagtacgttaataaggtgtatgtctggaccttctccgacgatatcaaacctctcgtggccacaagaaagctgctcgacaccagcttcgatgcgaaacggattgggacaatcaccgacacgggcattcagaagatcctgcgcaactaccttgaagctaaaggagggaatgccacactggcctttacccccgagggaatcgctgagatgaaccaaaatatttccaagtataacgatggcaagcctcaccagcccatcctgaaagttagaattaccgaaccgatgggggccaagtaccgggtgggccagacaggaaataaaatggctaagtatgtcgaggcccaatctggcaccaacctctacttcgcgatctacgaagacagcgaggggaaacgctcctatacaacggtgcctctggatgaggttgccgaaagacttaagcagcggctgtctcccgtgcccgagaaggacgaaaatgatgtccctctcaaattttacctgagcccgaacgacctcgtgtatgtgcccaccgaggaggaactgcagcttagagagtgtaagctgaataaagaccgcatttacaagatggtctcctctacaggaaacgaatgccatttcatcccttattacgttgctaatgtgatctataacaaaggcgggtttaatatgcagatgcaccggccccaaagctga

SEQ ID NO: 4543 - RNA, 4374 nt, synthetic construct
  misc_feature 1..4374: note = Cas9 variant
  source 1..4374: mol_type = other RNA
atggccaagatcctgggcctcgacctggggaccaacagcattggatgggctatcgtggagaaaaataactccgatttcacacttattgacaagggcgtcagaatcttttctgaaggggttaaaacggagaagggaattgaacggagccgcgccgcggagagaaccggctaccggtccgctcgcaaaatcaagtatagacggaagctgcgcaaatacgaaacactcaaggtgctgtctaaaaatagaatgtgcccccttcagatcgaggatgtggaggcctggaagaaaagcgggttcaaggactatcctctgattccggaatttctccaatggctgcggaccaacgatcacgagaatgtcaacccctacttctttcgcgacaaggcctccagagctaaagtgtctctgtgggaactcggacgggccttctatcatatcgctcagcgcagaggctttctgagcaatcggcttgatcagtccagcgagggcgttctggaggaacacaaccctcagattcaatctctcatcgaggacctggaagagacatccaccattcttaatgaagtgcgcgattactatatcaacctggggctcctggacggagtcaagggcgatttcaaaaaggagctggacgagggggagaaaaagctcaaaagcctgtacaatacacttattgccatcatcaagaagaacgaaaatgatgtgcagaaatgtaaggacgaaattatcaaaagactgaacaagaaagaggacctcggaaaggttaagggcaaaattaaggatatctctcaggcgatgctggacgggaattttaaaacccttggacagtacttctattccctgtacaacaagggcaaaattcggaaccaatatacgagcagagaggaacattacctccaggagtttatcaccatctgcaaggtgcagggcattaatgggatcaacgatgaagagattctgcccgaaaagaaattcacaggactggccaaggacctctataaagctatctttttccagcgccctctgaagtctcaaaaaggccttattgggaagtgttccttcgagaagaataaaagccggtgcgccatctcccaccccgattttgaagagtacagaatgtggaactatctgaataccatcaagttcggaacacagtctgacaaaaagctccgctttctgacccaggaggaaaaacttaagctgattcctaaattctaccggaagaacgattttaatttcgaggtcctcgctaaggaactgatcgacaaaggcgccacgtttgggttctacaagagctcccggaaaaacgagtttctgtattggttcaattacaagccgacagataccgtgagcgcgtgtcaattttctgcctccctcaaaaacgctattggagaggactggcagacaaaggtgttcacctataagaccctgaatagcgagaaaaaggaagtcatccgcacagttgattaccgggacctttggcatctgctctctgccagcacgtccgacatttatctgtacgaatatgctaaagagaagctgggccttgaagataaatctgccaagacctttagcaagatcaaactcaagaaagacttcgcctccctgagcctgtctgctattaacaagatcctcccctacatcaaagagggcctgctttactcccacgcggtgttcatggccaatattgagaaggtggtcgatgaacacatctggaaggacgtgaaagagagaacaattatccagaacgaaattagcaagatcatcaaatctgatgtttttgagcgcgaagtgattaatatcattaacgggctgatcaagaactccaaaaccgagggagagaattatgctgaagagagcaagaacattttcaaaacagaatttgacaatgccatcgccaagatcttcgagaagaacaatgatattgaatttaaccagcctttcctcgacgatacctacctgaaatatgtcgaggagctgaagaaatttgacaaggctcggtccttccttcccgtgcctagactcgatgaaaaagttatccaatttctgctgggcaataacaaggacgggatggtgtactgctctgataagaataaaacgaagaaactctatcatcccagcgacattgagatcttcaagaaaaagattatcaaggacgaatttggaaacgagaaaatggtcctgggctccccgcttacaacctctatcaagaatcctatggccatgcgcgcgctgcaccagctccggaaagtgctgaacaccctgattcttgaggaacagatcgatgagaatacacggattcatatcgaaatggctagagagctcaacgacgccaataagcgcaaagggattcaggattaccaaaacgaaaacaagaagttcagagaggacgccatcaaagagattaagaaactgtattttgaagagtgtaagaaagaagtcgagcccaccgaagaggatgtgctgcggtaccagctctggatcgagcaggacaagaaggaaatctacgagcagggcaaaagcattagaatctccgatattatcggaagcaatcctgcttatgacattgaacacacagttccccgctctatctcccaaaacaatagcctgatgaacaagacgctttgcacccccagattcaatagagagatcaaaaagcagaaaatgcctattgaactgtctaactacgaggagatcctcccgcgcattgaacactggaagaaagaggccgaagatctgacaagacagatcgagtccattagcaagtctatcaagagcgcttccaccaaagaggccaaggacaaaaatatccggcgcagacattatctgacacttaagcgggattacctcaaaggcaagtatgaccgcttcatttgggaggaacccaaggtggggtttaaaaacagccagatccctgataccggaattatcacgaagtacgcgcaagcctatctgaaatcttacttcaagagagtcgaatccgtgaaaggcgggatggttgctgagtttcggaagcagtggggcattcaggaaagctacatcgacgagaatggattcaagcactataaagagaaggaccgctccaaacatacccaccatacaattgatgccatcaccatcgcttgtatgacaaaggacaaatacgatgtgctggcccaagcgtggacctctgaagacgagcaggataagcagaaggccaaaacgctcatgagcgaagctaagccctggaaaacatttaaggaggacattgagaaaatcgaagaggaaattctggtctcccacttcacccttgataacgtgaagaaacagtctaagaagatcgtgagagttcgggggaaaaagcaatatgtcgccgagattgaacgcgacgtgaatggcaaagctatggccaagaaagatgccaacggaaagatcatctacaagctgaatgagaaaggcgaaaagattcctagactccagcagggggacacaatccggggaagcctgcaccaggattccatttatggcgctatcaaaaaccccctgaatcaagaggagattaagtacgtgatcagaaaagaccttgaatctctgaaggcgaacgacgtcgataacatcgtggacgagaccgttaagcagaaagtgaaggaagccattgagaataaaatcctcctgctcagctccaacgctcagcagaagaataaactggtcgatgacgtgtggcttaacaaggagaagcaagttccgattaaaaaggtgcgcatctatgccaatagcgtcaaaaaccctctggaaattaaggagcagtctctcctgtccaaaagccggaaggaacataaacagaaggtgtacgggcaaaatgatgagaactacgccatggctatctatgaactggacggaaagagagagtttgagcttattaataacttcaatctggccaaactcatcaagcagaaagaaggcttttaccccctgaacaaggagaaagaagttaaggggaagaaagtgctctatcctatcgcgaagtctaattaccgcgatgtcgtgctgaaacggggccaacaggtggtcttctatgacaaggaggttgaaaaccccaaagatatttccgaggtgatcgactttaagggaagaatttacatcattgagggccttagcatccagcgcatcgtgcggccttctgggaagattgatgaatatggagtcatcatgctgaaatacttcaaggaggctagaaaagccgacgaaattaagaaagataattacaagcccgacggcgtgttcaagctcggggagaaccgcccgacccggaaaatgaatcactcccagtttacagccttcgttgaaggaatcgactttaaggtgctgcctacgggcaaattcgataagatttga

SEQ ID NO: 4544 - RNA, 4377 nt, synthetic construct
  misc_feature 1..4377: note = Cas9 variant
  source 1..4377: mol_type = other RNA
atgaccaagacaatcctgggcctcgacctggggacgaacagcattggatgggcccttatcaatcaggatttcgacaacaaaaagggcgagattctggggatgggatccagaatcattcccatgacccaagatatcaaagacgaatttggcaagggaaattctatcagccagacagctgagcggacccgcctcagaggggtgcggcgcctgattcacagaacacttctgcggcgcgaaagactccatcgggtcctgaacatcattggcttcctgcctgagcactacgccaatcagatcgattttgaaaaacgcttcggcaagtttaagccggagtccgagcccaaaatttctttcgacgggaacgatgtttttctcttcgaaaagagctatcaggagatgctggtggactttaaaatccatcaacctcagcttgtgtccaatggaaagaaaattccccacgattggaccatctactatctgagaaagaaggcgctctctaaaaagatcgaaaaagaggagctggcttggattcttctgaacttcaatcagaagcggggctactatcagctccgcggggaagaggaagaggaaacacctaacaaactggtcgagtttcatagcctgaagatcgtggaggttaatgccgacgaaccccaaaaaggaaagcctgagatttggtactccctcgtgctggaaaacggctgggtctatagacgggccagcaagaccccgcttttcgattggaaagacaagatccgcgagtttattgtgacgaccgaaatcaataacgatgggacagttaaaaccgacaaggagggaacagagaaaagatctttccgggctcccaagcctgaagactggaccctgcagaagaaaaagacggagttcgaactctccaaaagcggcaatgaggtgggcgcctttatctacgaatctattctgcagaagcccaaccagaaaatcagagggaaacttatttccacaatcgagcgcaagttctacaaagaggaactgaagaccattctcaaaacacaactgtttttccacaaggagctgaaagatgaaaagctctataacgcttgcatcgaggagctgtacaagaataacgaagcccaccggagccttctgtctaataaaggatttgagcatctcttcatcaacgacattctgttttatcagagacctcttcgctccaagaaaagccagatctccaattgtcccctggaaaagcggacctacaaaaaggagggcattgaaatcaccgaggggattaaagtcatctctaagagcaacccgatttatcaagagttcagactctggcagtggatctccaatctgagcctgtactgcatcgaacctacagagacgaacgtgacctctacatttctcaattccattgaagattatgagaacctgttcgaatttcttaataaccgcaaggagatcgagcagaaacatctgctcaagtacctgctggaaaatcagggattcaaaggcaaacttctcaccaacgagctggaaaagtttcggtggaatttcgtggcggacaagaagtacccctgtaacgagacagggagcctgctccacaccagactgtctaaagtcaagaacattagccctgatttccttacgaaagaaatcgagcaccaactgtggcacattatctattccgttacagacaagatcgagtacgaacaggccctcaaaacctttgctcgcaagaataacctggatgtggactctttctttgagcatttcaagaaaattcctccctttgaaagcacctatggagcctactccgagaaggctatcaaaaagctgcttcccctcattcggctgggcaaatattggaattgggaggccatcgatagcatttctaaggacagaatctccaagatcctgagcggcgaatacgatgagaacattaaaaatcgcgtgcgggaaaaggcggtccacctcacatctgagaacaatttccaggggctgcaggaatggcttgccaaatatatcgtgtacgacagacattccgagggaaacgacctgggcaagtggaccagcgtttccgatctcgagacatacctgaaagaatttaagcaacactctctgcggaatccgattgtggagcaggtcatcacggaaacccttcgcgtggttaaagacatttggatcaagcatgggaagggaacagagaacttctttgatgaaatccacgtggagctcggcagagagatgaaaaataacagcgaagaccggaagagactgaccaatacaattaccgagaacgaaaatacgaacctgcgcatcaaagctctcctgatggagatgatgaacgataatgacgtcgaaaacgtgcggccctattccccttctcagcaggagattcttaagatctacgaggatggggccctgaatagcaacattgaactcgacgatgagatcgtcaaaatttccaagaaggctgaacccaccaaaagcgagctgcaaagatataagctgtggcttgagcagaaataccgctctccttatacaggccaggtgatccccctcaataagctgttcacctccgaatacgagatcgaacacgttgtgccgcagagcagatttttcgacgattctttttccaacaaagtcatttgcgagagcgccgtgaataagcggaaggacaaccaactgggactccagttcatcaaaaatcattctggcgaaaaggttgagctggggttcggaaaagtggtccaggtgtttacagaggaacaatatcttgatttcgtgaaggagcactacagcaaaaaccgctccaagcataataagctgctcctggaagagattcctgaaaagatgatcgagagacagctgaacgacacccggtacattagcaagtttgtttcttccatccttagcaatatcgtccgctccgagaaagacgatgacggcctgaactctaagaatattctccccgggaacggaaaaatcacgacagaactgaagagagattggggcctcaacgacgtgtggaatgatctgattcttcctcggttcgagcgcatgaacaccatcacaaatagcgacctgtttaccacctataacgataagtaccagaaacacctccccacagtgcctttcgaatattccaaggggtttcagaaaaagagaattgaccaccggcatcacgccatggatgctctggtcatcgcgtgtgccacgcgcgaccatctgaatcttatgaacaatcaatctgctaaaagcgagctgaagagatacgatctccagaacaaactgcggaagaaggaaccctatttcaatcagaaagagaacaagcagaaagaggcctttaaggacttcatcaaaccgtggggcacctttacagaagattccaagaatgccctcgagaagattatcatttctttcaaacaaaacctgagagtgatcaataaggctaccaacagctacgaatcctataaagacgaggacggaaatcttcgcattggcaaggatgggaaacctgagaagggactgatcaagcagaaaggcctcaactgggccattcggaagcccctgcacaaagacacagttagcgggcagatcaatctgtctagaatcaaacttcccaacggaaagattctgaccgcgacgcgcaagaacctcgatacatccttcgacctgaagaccatcgaaaatagcattaccgatacaggcatccagaaaattctcaagaactacctgctttctaaagagtcccctgaactggcttttagcccggaggggctggaagagatgaataacgagatcgaaaagtacaataacggcaaattccatcaccccatcaataaggcccggatttatgagctcggatctaaatttaacgtgggccaaaccgggaatagacgcgacaagttcgtcgaagccgctaagggaacaaacctgtttttcgccatctaccaggatgagaataaaaaccggtcctatgaaacgattcctcttaatgaggtgatcgagcaccagaagtggagagctagcctgcccaaagaggagcaagaaaagattcctctcgttcccgtgaacaaactgaagggcacctttatcttctccctcagccctaatgacctggtctacgtgccctctaacgatgagcttgaacgcagcgcctccatcgacttttctaagctgaaaaaggagcagattaaccggctgtataaaatggttagctcctctgggagccagtgcttctttgtgaagtccgaggtcgcgacatctgtggtgaataaaatggaatacagctccctcaacaagatggaaaagagcatcgataatctgatggtcaaagaaatttgtatcaaacttaagattgacagactgggaaacatctctaaggcctga

SEQ ID NO: 4545 - RNA, 4377 nt, synthetic construct
  misc_feature 1..4377: note = Cas9 variant
  source 1..4377: mol_type = other RNA
atgaagaaaatcctgggcctcgacctggggaccaacagcattggatgggcccttatcgagcaggatttcgaatccaaggctggcaaaatttctggggccggaagcagaatcattcccatgtcccaagacatcctgggcacatttgagacggggcagtcttacagccagaccgcggatcggacacactatcgctccatcagacggctctaccagcgcaccaagctgagacgggaacgccttcatagatctctgaatgtgctcggattcctgcctgagcactataaaaacgaaattgactttgagcaacggaagggccagttctacccgaataaggagcccaaaatcgcttattaccctgaacaggtcgccagcaaggttaaatatcagtttctgttcaagtccagctttctcgagatggtggaagatttcaaacgcagaggctacaacggggccattccctacgactggacaatctattacctgcggaagaaggctcttgagaaaaagattgagaaagaggagctggcctggctcctgcttaattttaaccaaaagcgcggatattaccagctgagaggcgaagaggaagataccaattctaacaaaaaggaggagttctatgaactcaaagtgtccagcgtcgagcagacacatgacacctctccttccgggacgtggtacaatgtgcatctgcagaacggatgggtttatcggcgcaagagcaaggattctctgaaagactgggaaggcctcaataagaaatttatcgtgaccacacacctgaacgctgatgggtccgagaaacttgacaaagatggaaatgtcagcagatccttccgggcccccaaggaagacgactggggcctggtgaagaaaagaaccgagtctgttctcgaaaagagcggcctgcacgtgggggaatttatttacgagtcccttctggaaaaccctgagcaaaagatccgcggaagcctcatcaagacaattgaacggaaatactataagaaggagctggaggcgatcctggataaacagacctctttccacagagaactccgcaatgacgccctgtacaaggaggctacgcttgaactgtatccgaaaaactccgcccatcggagcaacattaagcagagaggcttcaaatacctctttatcgaggatattatcttctatcaacgccccctgaagtctcagaagcaccttatcgctcattgccagtacgagaaacggacatataagaataacgggggagaaaccattgaggtcagcctgcagggcgcccctaaatcccacccctcttttcaagaatttagaatctggcagtttattagcaatctccgcttctacgacaaggaggaaatcgtggaggggcaggaggtgtccattacagaaaaactgctcaagagcgattctgactttgcggagctgtaccactggctgtcccatcagcgggaagtcgatcaaaacaaaacccttaagtatttcacccagaagaaactgatccctaagcagaaaaaggacaatcccacaatcagatggaactttccggaggataaaaagtacgaaatgggagagttcaaggcccagctcctgagccgcctggagaaagttcggaattgtcaacctgacaagtttcttacgcagaaaaacgaactcgatctgtggcacattatctattctgtgaccgacaagacagagttcgaaaaagctctggtgacctttgccgagaagagagaactcgactccgagagcttcgtcgagaatttcaagaaatttccccctttcaagaacgattacgcttcctattctctgaaagccattaagaaaatccttcccctgatgcggcgcggcaagtactggaaggccgaaaatctcggcccccagacactgcagagaattgagaaaatcgtgaacggggaagctgacgataagattagcatccgggcgagaaaactggcccttcatctcaatgacaccaagtcctttcaaggactgcctacgtctctggcttgctatgttgcctacaaccgccacagcgagaatgaggaaaaccagaaatggcagacaccgtccgatatcgacaagtacctcaaagatttcaagcaacatagcctgcggaaccccattgtggagcagcttatcaccgaagccctgagagtcgtgcgcgacatttggaagcactatggccaggggcagaaagatttcttcgacgagatccacgttgaactcggaagagagatgaagaatcctgctattaaacggaagaaactgtctcaaaagatccaggagaacgaaaataccaactaccgcatcaaggaggtgctgagaaatcttaaagaaaacaatattgatgccaagccctattcccctagccatcaggagatcctcaaaatttacgaagagggcgtctatcagtctatcgagaacgtggaagacgagattgaaaagatccggaaaaataacacaccctccagcaaggatatcaatcgctacagactgtggctggagcaagggtatatttctccgtacaccggcgaagtcatccctctcagccagctgttttccaaccagtacgagattgagcacatcattccccggagccgcttctttgacgactctcttgcgaataaggtgatctgtgaatccagcgttaacgctctgaaagataataagacagccctcgagttcatcacgaaccatggaaacgaaaaagtggagtttgccggcaagaccgtcgagattctgtcctctgacaaatatacagaacactgcaagagatacttcaagcggaatcgcaccaaactgaagaaccttctcagctatgatgtgcctgaggggtttatcaatagacagctgaacgactcccggttcatttctaaatacgttagaaatctgctcagcaacatcgtgcgcgaagaggaggaacgggaggctatttccaagcacatcctgacaattcccggatctatcaccagccaacttaaacaggattggggcctgaatgaaaagtggaacgaggtcgtgacgcatagattcgaacgcctcaataacctgaccgggacaaccgactttggattctgggataataagatcaacgcctttcggattacagtgcctaaagagctgtccaagggcttcaataaaaagagaatcgaccaccgccatcacacccttgatgctctggttattgccgcgtgtacgaaagaccatgtcaactatatcacaagcctcaataccgaacggaacaaccactctctggtgtccaagctcagaaataccaaaaaggtgctgattaacgggaaggagcgccggatcgccaaggcttacaaacttccctggagctcttttccgctggatgccaaacaccagctcgagacaaccgtcatctccttcaagcaaaatctgagagtgattaacaaaagctctaataagacatggcagtggcggaacgttaatggcgaacagaagaaaaagctgatccctcagacgaaaggagactcctgggctattcgcaagagcatgcataaagccaccgtgtccgcgaaggtcgagagcgtgggcaaggggaaaatcaagacaaccaacagaacaccccttggagaaattaaaggcgagaagcacgttgagaaaatctatgatgcccggatccgcgaagtgattatccccaatcatctgaacaagtacctcgacgagaaggggaaacctaattacgaagctgccttttctcaaagcggaattaagcagctgaacgagaatatcgaagtcctcaacgagggcaaaccgcacgctcccatttataaggtgcctctgttcgaggttgggtccaaatttcccgtgtctgaagacgccaagagccctaaaaatcagaagtacgtcgaggccgataagggcaccaaccttttctttgctgtgtattggaatgaagagaaacagaagagaaacttcgaaacggtgcccctgcatcaagtcatcgttcaccagaaacaggtggcgtccctccctacagagcagcggacctctgtgcccattaagccggagctgggactgttcctttttagcctgtcccctaacgacctcgtctacgtgcccaccgaagaggaaatcgagaatcctcacctggttgatctcaaaaacctgtctaaggaccaaacaaatagaatctataagatggtgagctccaccggcaacgaatgccatttcattccccaccatatcagccgccttattatgaaatacaatgccaagcagaaagtcggggagtttggatctctgaacaaggctgagaaagccatcacaggcgaaacgattaaggagaagtgtctgaaaatccagatcaattccctcgggaagctgaaaaccgaacggattgcctga

SEQ ID NO: 4546 - RNA, 4380 nt, synthetic construct
  misc_feature 1..4380: note = Cas9 variant
  source 1..4380: mol_type = other RNA
atgaagttcaacctgggcctcgacatcgggaccaatagcattggatgggccctggtgaacgaggattacgaaaataaaaagggcaaaatcattgctgccgggtccagaatcattcccatgacacaggacatccttgataagtttggatctggcgcgatcacggagacccaaacagctctgcggaccgactatcgcagcaaaagaaagctcattcagcggttcctgcttcgcagagaacggctgcaccgcgtcctcaacgttctggattttctgcctaagcattacgccgagtccatcgacttcgaaaaatattttgggaagttcctcccgaatacagagcccaaactggcctacaaccagaatcagtttattttccaaaactcttttcttgagatgctgaaggaatttcaggagaaacaccctgaactcctgaccaataacaagaagatcccctatgattggacaatttactatcttagaaagaaggctctgaatcagcggatcgagaaagaggaactcgcctggctgctgctccagtttaaccaaaagcgcggatacaatcagctgagagacgaggaagaggaaagcgtgcctaacaaacaggtggagttctactcccttaagattatcgatgtcgtggctgaccagcccaaagagggccgggataagcgctggtattctatcaatctggaaaacggctggacctacagacgggagagcaagacgcctctctttaactgggaagggaaaaccaaggacttcattgttacaaccgatctgaatcaagacggatccatcaaaaaggacaaagagggcaaggaaaagcgcagcttcagagccccgtctgagggggattggacacttctgaaaaagaaaaccgagaaggaaatttatgagtccggaaaaacgctcggcacatacatctatgacgcgctgctgaacacccccgatctcaagattaagggggactttatccggacaatcgatagaagcatttacaaagaggaactgcagcagatcattaataagcaaaaagaatatcatcttgagctgaactcttccaagctctacaaagcctgcctggaggaactttaccctaagaatgagatctataagagcgctctgaaaaacaaggacattgcctacctcttcatcaatgatatcctgtattaccagcgccccctgaaagctcctaagtataacattggaaaatgtacctacgaatctcggacctttaagaaagaggacaagaagatcagagagtatattcccgccgtggcgaaatcccaccccctcttccaggaatttcgcctgtggcagtggatcaagaatcttaaaatttacgagaagctgagctccgataactgcacagacttctttctcacgaatgaacaagatttcgagaacctgtttgagttcctgtggaataaaaaggaaatcgaccataagggcattcttgagtacctcgtcaaaaccaagtttcctgacctgaaacccaaacaggtgaaaacaaaggttaaggaatatcggtggaactacgtgtatgatcacgagaaagacgaatctaagacctacccttgtggcgagacatatttcctgctcaaaaataagctggataaaatctacaacgcccaggacgattttcttgacaaggaaagactgtataacctctggcacatcatttacagcgtcaccgataagaaacagtacgagaaggctctggccaaattcgctctgaagaatcatcttgacacgaaatccttcgtgaacacatttaagcgcatcccgcccttcaaaaatgattatgccatttacagcctcaaggccatcaagaaactgctgcctctcatgcgggtggggaagtattggaactacgacgatattgacccgatcaccaaacaaaagatccagtgcattatcaccggagaggaaaatgatacaatttctaccctggtcagagagaaaacaaaccacttttccaatgaaaacgacttcaagaatcttcccctgtggctcgctggctatatcgtttacaacagccataatgagtctagcgaaattgagaagtggaaatcccctcaggacatcgatacgtttctgaagaaattcaagcagcacgcgctgcgcaaccccatcgtggagcaagtggtcaccgaaacacttcgggtggttagagacatttggtctaaaaaggggcagggaaagaaagatttcttcaatgagatccacattgaactcggcaaggacctgaaaaaccctgtggataagcgccggaaactgagctccaccaatacaaagaacgagagcaccaacacgagaatcaaggccctcctgattgagctttttacccagggggtcgaaaatgtgaaacccaactctccgaagcatcaggagatcctgaaaatcttcgaagagggagctctcaattccggcattgaaatcgaggaggacattatcaagattagcaacacagatcaacctaccaaaaagcagctggaactgtatatcctttggctcgagcacaagtacaaatctccctacacaggccagtccattcctctgagcaagctgtttacccccaattatgaaatcgagcatatcattcctcggtccaaatactatgacgataacctctctaataaggttatctgtgaaacggagattaaccgcctgaaaaataaccaacttgggtacgagttcatcaataaccacgaaattagagaggtgacactggaagagggaaagaccatccggctcctgagccccgaacagtattggaattttgtcacaacctactatgccaaaaacaaggccaagagagagaatctgcttctgaaagagctcccggtgcagatggtcgaaaagcagctgaacgacacccgctacgtgtccaaatacgttatgcaactcctgtctaagatcgtgcggaaagaggatggcacagacaacgggattaatagcacgaacatcctttccattagcggaaagatgaccagagctctgaagaatgattgggacctcaacgacgtctggaatgatctgctgctttatcgcttcgaaagactgaacacaatcaccaaaacaaatctcttcaccacgtactctgagcagaagcagaaacggatgcctattgtgcccgaccagtatgccaagggctttcataaaaagcgcctggatcacagacaccatgcgctcgacgctatcgttatcgcctgcattacacggaaccacatcaattacatgaacaatcaaaacattcagggggagaagctgaaaaagaatgccatcgaaaaagagaactatcgcgaaattcttcagaagtccagactggatatccgggctcagctctgtgagaaaaagtacaatgacaacgatcccaccaagtataattgggtgttcattaaaccttgggccgactttaccgaaaacacaaaggatatcctggagagcatcattccgtctttcaaacaaaacctgcgcatcattaataagaccgtcaactactacgagaaatataatgaaaacggcaagaaagtgaaggtgagacagatcaagggagacaattgggctattcggaaaccccttcataaggagacaatctccggcaaagttcacctgagctacaagacgcctgccaaagggaagatcctcaccgcgacacgcaaggtcctggattctagcatggactttaaatccattgaaaagatcaccgacacaggcattcagaaaatcctcaagaactatctggagtacaaaaagagccccgaacttgccttctctcctgagggaattgaggaactgaatgctaccatcacgaagtataacaatgggtttcaccataaacccatctacaaggtgagaatttatgaggaaggagtgaaattccctctgggcaacaaggggaataaaaagtccaagtacgtcgaggccgaaaaaggcaccaacctctttttcgctatctacaaggatcaagagaataaccggtattttgagacaattcccttcaatgacgtgctggaaacccttaaaaagggaatgagcgccgttccggagaaaaaccaggaagagaacacactggtgttcgcgctctcccctcaggatctggtctttgtgcccaccctcgacgagatcgaaaatcctgatattgttgacttcaagaacctgacaaaagatcagaccaatagaatctacaagatggtgtctagctccggcaagcaatgctttttcattaaagccgaggtcgctacgtctatcgtgaacaagatggaatttagcacatccaataaaatggagaactctatcgaagggattcagatcaagagcaattgttggaaacttaagctggaccgcctgggaaccattacccgggttatcaagtga

SEQ ID NO: 4547 - RNA, 4383 nt, synthetic construct
  misc_feature 1..4383: note = Cas9 variant
  source 1..4383: mol_type = other RNA
atgaccaagttcaacctgggcctcgacatcgggacaaatagcattggatgggccctggtgaacgaggattgcgaaaataaaaagggcaaaatccttgctgccgggtccagaattatccccatgacgcaggacattctggataagtttggatctggcgcggctaccgagacacaaaccgccctccggacagactaccgcagcaaaagaaagctgatccagcggttccttctgcgcagagaacggctccaccgcgtcctgaacgttctggattttctccctaagcactatgccgagtccatcgacttcgaaaaatacctggggaagtttcttccgaataccgagcccaaactggtgtataaccagaatcagttcatttttcaaaactctttctttgagatgctcaaggagttccaggaaaaacaccctgaactgtttcttaataaccagaagatcccctacgattggacaatttattacctgagaaagaaagctctcagccagaagatcgagaaagaggaactggcctggctgctcctgcaattcaatcagaagcggggatataaccagcttcgcgacgaggaagaggaaaatacccctgataaactggtggagttttactccctcaagattatcaaagtcacggctgacgaggccaaggaaggcattaacaagagatggtactctatcaatctggagaacggctggatctatcggcgcgaaagcaaaacaccccttttcaactgggaggggaagaccaagaatttcattgtgaccacagatctgaaccaggacggatccatcaagaaagataaggaaggcaaggagaaacggagctttagagcgccttctgagggggactggaccctcctgaagaaaaagacggaaaaagagatttacgaatccggaaagacactgggcacctatatctacgacgccctcctgaataacccggatcttaagattaaaggggctctgatcaagacaatcgaccgcagcatttataaagaggaactccaacagatcattaataagcagaaagagtaccattctgagctgaacaattccaagctgtataaggcctgtcttgaggaactctaccccaaaaacgaaatctacaagaatgagctgaaaaacaaggatattgcttatctgttcatcaatgacatcctctactatcaaagacctctgaaagcccccaagtacaacattggaaaatgcagctatgagtctcggacctttaagaaggaagataaaaagatcaccgagttcattcctgcggttgccaaatcccaccccctttttcaggagttcagactgtggcagtggatcaagaatctcaaaatttacgaaaagctgacaaacgacaattatacggactttttcctgaccaacgaacgcgatatcgagaaactttttgatttcctctggaacaaaaaggagattgaccataaaggcatcctggaatacctgatcaagacaaaatttccggatctcaagcctaaacaggtgaaaagcaaggtcaaagagtaccggtggaattatatttacgaccacgaaaaggacgagtccaaaaactatccctgtggcgaaacctacttcctgcttaagaataagctggataaaatcacatctattcaagacgattttctcaacaagaaaagactggagaatctgtggcacatcatttatagcgtgaccgacaagaaacagtacgagaaggctcttgccaaattcgctctcaagaaccagctggatacgaagtccttcgttaatacatttaaacgcatccctgccttcaagaacgactatgccatctacagcctgaaagctattaagaaactcctgccccttatgcgggtggggaagtactggaattatgatgacatcgatcccattaccaagcagaaaatccaatgcattatcaccggagaagagaacgacacaatctctaccctggtcagagaaaagacaaatcatttttccaacgagaatgatttcaaaaacctcagcctgtggctggcgggctacattgtgtataattctcacaacgaaagctccgagatcgagaagtggaaatctcctcaggacattgatacgtttcttaagaagttcaaacagcatgccctccgcaacccgatcgtggaacaggtcgttaccgagacactgcgggtggtgagagacatttggctgaagaaagggcaaggaaagaaagactttttcaatgaaatccacatcgagctcggcaaggatctgaagaaccccgtcgacaaacgccggaagattagctccaccaatagcaaaaacgagacaaccaatatcagaattaaggcccttctgaaagaactcctgaaggaggggatcgaaaacattaagcctaattctcccaaacagcaggagatcctgaagatttttgaagagggaatccttaactccggcatcgatattgaggaagagatcattaaaatcagccagattgctcaacctacgaagaaacagctccagtactatcgcaattggctggaacaaaagtacatctctccctataccggccagttcatcccgctgtccaaactctttacaagcaagtacgagattgaacacatcattcctcggtccaagtactatgacgattctctgagcaacaaagtgatctgtgagaccgagattaatagacttaagaacaatcagctggggtacgagttcatcaacaatcatgaaatccgggaaattacactcgaggaaggaaaaaccatccgcctgctgtcccccaagcagtatcttgactttgttacgacatactatggcaaaaacaaggccaagagagagaacctgctcctgaaagagattcctatccaaatgattgaaaatcagctcaacgatacccggtacgtgtctaagtatgtcatgcagctgcttagcaaaatcgtgagaaaggaggacgggacagataatggaaccaactccattaatatcctgagcgtttctggcaaaatcacccgcgtgctcaagacagactgggggctgaacgatgtctggaatgacctgctttgctaccggttcgaaagactgaacaagattacgaataccaacctcttcacaacctactccgagcagaaacaaaagatcattcccatcgtgcctgatcagtatgctaaaggctttcacaagaaaaagctggaccatcgccaccatgccctcgacgcgattctgatcgcttgtatcacaagaaatcacattaactacatgaataaccagaatatccagggagagaaacttaagaacttcaagattgataaacacaattatcatgaaatctttcaaaagagccggctggacatgcgcgcccagctctgcgagaaaaagtacaacgatcacgactctaccaaatatacgtgggtcttcacaaagccctgggccgattttaccgaaaacattaaggacaccctggagttcatcatcccgtcctttaaacagaatctgagaattatcaacaagacagtgaattactatgaaaaatacaacgagaatggcaagaaagttaaggtgcggcaaaccaagggggataactgggctattcgcaaacctcttcataaggagacaatcagcggaaaagtccatctgctctacaagacgcccgccaaaggcaagattctgaccgctacaagaaaggtgctcgactctagcatggatttcaaatccatcgaaaagattaccgacacagggatccagaaaatcctgaagaattatcttaaatacaaggagagccccgaactggccttttctcctgagggaattgaggaactgaacatcaccattgcgaagtataatgatggcttctaccacaaaccgatctataaggttcggatttacgaggaaggggtgaaatttcccctcggcaaccgcggaaataagaaaaacaagtatgtcgaggccgaaaaaggcacgaatctgttcttcgctatctacaaggaccaggagaacaatagatactttgaaaccatccctttcaacgacgtgcttgagacactgaagaaagggatgtccgccgtgcccgagaagaaccaggaaaagaataccctcgtttttgctctgagccctcaagatctcgtcttcgtgcccacactggacgagattgaaaaccctgatatcgtggactttcggaatcttaccaaggatcagacaaaccgcatttataaaatggtctcctctagcggaaagcagtgtttctttatcaaggccgaggtggcgacctccattgttaataaaatggagttcacgacatctaacaagatggaaaatagcatcgagggcatccagattaaatccaactgctggaagctgaaactggacagactcgggaccatcacccgggtgattaagtga

SEQ ID NO: 4548 - RNA, 4389 nt, synthetic construct
  misc_feature 1..4389: note = Cas9 variant
  source 1..4389: mol_type = other RNA
atgaccaagaacatcctgggcctcgacctggggacaaatagcattggatgggcccttatcaaacagaacttcgagaataagcaaggcgaaattctggggatgggatccagaatcattcccatgtctcaggatatcctcggcgactttgggaaaggaaacagcgtgtcccagacggctgagcggaccaagtaccgctctgtcagacggctgcgcgaaagattccttctgcggcgcgagagactccaccgggttctgaatctgctcaactttctgcctcagcattatgccagccaaatcgatttcgaaaaacgctttggcaagttcaaggtggagacagagccgaaacttgcgtggaagaatattgacggccagttttccttcctgtttcagacctctttcaacgaaatgctcgaggattttagagtgaatgggcaggacgtcaaaatcccctacgattggacaatttattacctgcggaagaaagctcttagcaagaagatcgaaaaagaggagctggcctggattctcctgaacttcaatcaaaagcgcggatattaccagctgagaggcgaagaggaagaggaaaaccctaataaactcgtggagttttattccctgaaggttgtggacgtcgtggccgatgagccccagaaagggaagttcgacatctggtacagccttattctggaaaacggatgggtttaccggagatcttccaaaatccctctcttcgattggaaggacaagacccgcgattttatcgtgacaaccgacctgaatgacgatggcagcattaaaaaggacaaagatgggaacgagaagcggtctttcagagctccctccgaaaacgactggacgcttgtcaaaaagaagaccgagcaggaaatcgagcaaagccgcaaaacagtgggaacctatatttacgaggccctgctcgataatcctaagcagaaaatcaagggcaaactggtgcggacaattgaaagaaagttttataaggaggaactgcgccagatcctcgagaaacaaaaggaatttcaccaggagctgcagtctgacgatctttacaacgactgcgtccgggagctgtatagaaataacgaagctcatcagctcaccctgtccaaaaaggattttgttcaccttctgatggacgatctcatcttctaccaacgcccgctgcggagccagaaatcctctgtgagcaattgtacgctggagtttagaaagtataaggacgaaaacggcgccgagcatacacagtacctcaaagcgattcccaagtccaatccttactatcaggagttccgcctgtggcaatggatctacaaccttaatatttatcggagagaagacgagcagaaccccatcaccggggaatttctgagcacaaccaaagagttcgaaaatctctttgagttcctgaacacccgcaaggaggtggatcagaaagccctgcttaagcactttaaactcaatgacaagacacaccggtggaacttcgtcgaagataagaaatacccttgcaatgagacgaagaccatgatttcttccagactggaaaaagtggagaacatcagcgacgatttcctgacacgggaaatcgagcagaagatttggcatatcatttattctgttaacgacaaaatcgagtacgaaaaggctctcaagagctttgccaaaaagcaccatctggatgagtcctctttctttgaggctttccgcaaatttcccccgttcaagagcgaatatggatcctttagcgaaaaagccgtgaagaaacttctgcctctcatgagactgggcaaatactggaattacgcggacattgataagtcttccaaagagcggatccaaaagattatcagcggggagtatgacgaaaacatcaaagatagagtccgcgagaagtctgtgcacctgaccacagaaaatgacttccagggacttcagctctggctggcccagtacattgtttatggccggcactccgaggctagcatgatcgggaagtggaactccgccgatgacctggaggaatttctcaaaaatttcaagcaacattctctgagaaaccccattgtggagcaggtcatcaccgaaacgcttcgcgtggtcaaagacatttggctgaagtacggaaatggcgctaaagatttcttcaacgagatccacatcgaactcggcagagagatgaagctgcctgccaaagagcgggaagacctgacacgcaagattaccgagaatgaaaacaccaatcttagaatcaaggccctcctggctgagatgatgaacgatagctccgtggaaaatgttcggcccttttctcccatgcagcaagagattctgaaaatctatgaggacggggtgctcaacagcggaattgaaatcgaggatgaatacctgaagatctccaaaacagcgcagcctagcccgtctgaccttaagcgctataaactgtggctcgagcagaagtacaagtccccctacaccggccagattatccctctgaataaactgttcacacccgaatatgagattgagcatatcattcctcaaagcagatacttcgatgactctttttccaacaagatcatctgtgaaagcgccgtcaacaaacttaaggataattatattgggctcggattcatcaaacagtttggcgggacgattatcgagctgggcttcggaaagtctgtgaaggtttttgaaaccgaggagtacgaagacttcgtgaaaaagcactatgctaacaatcggagcaaacgcaacaagctgctcctggaggatattcccgaaaagatgatcgagagacagattaatgacacacggcatatctccaagtacatcagcggcgtcctttctaacattgtgcgcatcgatgacgaccaggccaagaaaattatcgaagatgccgagattctggctagaaaggagatcgacaaagataaggccaatgaaatccggagaaaagcgaagtccctcgctaccgacgatgggattaacagcaagaatatcgtgccgggaaacggcaaaattacaacccaactgaagcaggactgggggctgaatgatgtttggaacgaccttatcctgcctcgctttgagcggatgaatcagctcacgaactccaaagatttcaccgtctggaatgaaaaccaccagaagtatctgcccacagtgcctattgagttttctaaaggattcagcaagaaaagaatcgaccaccgccatcacgccctcgatgccctggtgatcgcttgcgccaccaaggaccatgtcaaccttctgaataaccaatccgctaagtctgacacaaaacggtacgatctcaagaaaaagctgatgaaatttgaaaaggtggtttaccaccacacccagacgggcaataagattgagagagagatccccaaacagttcctgaagccttgggaaaacttcacatttgacgccaaatataatcttgagagcattatcgtgtccttcaagcaaaacctgcgcgtcattaataaagcgaccaactactatgaaaagtacgtggagaaggatgggaccaaaaataagggccgggttgaacagacaggaaccaactgggccatcagaaaacccatgcataaggacacagtgtctggcaaagtcaatctcccgtgggtgaaggttcctaaggggaaaattctgacggctacccgcaagatcctcgataccagctttgacctgaaatccatcggaagcattacagatacaggcatccagaagattcttcggaactatctggagttcaaagggtctcccgagctcgccttttcccccgaaggaatcgaggacctgaataagaacattgaaaaatacaatgatggcaagcctcaccagccgatcaacaaggtgagagtcttcgagctggggagcaaatttcaagtgggccagaccggaaataagaaagacaagtatgtggaggctgccaaaggcacgaaccttttctttgcggtctacgaagataagaacgggaagcggtcttacgagacaatccccctgaatgaagttattgagcgccagaaacagggactctccgtggtggacctgaagggcaccaacgatttctatctctgtcctaatgacctggtctacatccccagcgacgatgaacttgagaacattaataacatcgactttaaaaatattgccaaggagaaaaacgaaagaatctataaggtggtttctttctccgggagccaaatctttttcgtgcggcaggatattgctacctccatcgtcaataaggccgagctgagcacactgaacaaaatggaacgcgctatggacggatctatgattaaggagagctgcgtgaaactcaatgttgatagactgggcaacatctccaaggcctga

SEQ ID NO: 4549 - RNA, 4401 nt, synthetic construct
  misc_feature 1..4401: note = Cas9 variant
  source 1..4401: mol_type = other RNA
atgaccaagaacatcctgggcctcgacctggggacaaatagcattggatgggcccttatcaaacaggatttcgagaacaagcaaggcgaaattctggggatgggatccagaatcattcccatgtctcaggacgtgctcggcgagtttgggaaaggaaatagcgtctcccagacggctgcccggaccgattaccgcggcgttagacggctgcgcaagagattccttctgcggcgcgaaagactccaccgggtgctgaacgtgctgaattttctccctgtccattatgcgtctcagatcgacttcgagaaacgctttggcaagttcaaggaagatacagagccgaaactggcttacaacaaggaggggtttatcttcaaaaatagctttgaagagatggtggccgacttcagaaagcaccaaccccagcttctggaaaacgataaaaagattccttatgactggaccatctactatctccggaagaaagccctgtccaagaaaattgagaaggaggaacttgcttggatcctgctcaattttaaccagaaacgcggatactatcagctgagaggcgaggaagaggaagagaatcccaacaagctggttgagttctactctctcaaaattacagatgtgctggccgacgaacctcaaaagggaaagagcgatatctggtactcccttattctggagaatgggtggatctatcggcgcagctctaaaacacccctctttgactggaaggaaaagaccagagatttcatcgtcaccacggacctgaacgacgatggctccattaagaccgacaaagatgggaatgagaagcggagcttcagagctccttctgaaaacgactggacacttgtgaagaaaaagaccgagcaggagatcgataaatcccagaagacagttggaacctacatttatgaaacgctgctccagaacccgaaacaaaagatcaagggcaaactggtgtgcacaattgagcgcaagttttacaaagaggaactgaagcagatcctcgaaaaacagaaggagttccatcaagagctgcagaatgacgatctttatagcgactgtgtccacgaactgtaccggaccaacgaggcccatcagctcacactgtctaagaaagaaatcgtgaatctttttatggaggatctgattttctatcagagacccctccgctcccaaaagaccagcatctccaactgcaccctggagtttcggaaatacaaggacgaaaatggcgtggagcacacacagttcctgaaagcgattcctaagtctaacccctactatcaggaatttagaatctggcagtggattttcaatctcaacatctacaaacgcgatgacgacagcaatgtcacgaaggagtttctgaacaccacagaagatttcgagaatctttttgagttcctgaacaatcggaaggaagttgagcaaaaagccctcctgaagcactttaaactgaacgaaaaacttcatagatggaatttcgtggaggacaaaaagtatccttgtaacgaaaccaagacaatgatctccacccgcctcgataaagtggagaacattagcaaggacttctttacgcgggagatcgaacagaaaatttggcacatcatttactctgtcaatgataagatcgagtatgaaaaagctctgaagtccttcgccattaagcataacctggacgagaatagctttttcgaggcttttaaaaagtttcccccgttcaaatctgaatacgggagcttctccgagaaggccatcaaaaagctcctgcctcttatgagactgggaaagtattggaacgaagatgagatcctcaaatactctgacgattactttaagaatattgaaagcctgctgggcgtgcttaaacagcgcgacgagaacatctccgatgcggaccgggagaattataacaagacaattaataacaaactcagagccgaactggagaatttccagaacgctgaaatcgagagctttcaagggctgcggctccacattgcccagtacatcctgtatggaaagcactctgaaggcgataataaaaagttcaactccgctgacgaccttgagaagtttctgaaagagttcaagcagcatagcctccgcaatcccatcgttgaacaggtgattaccgagaccctgagagtcgtgaaagatatctggacaaagtacgggaacggagccaaagacttctttgatgaaattcacatcgagctgggccgggacatgaagaagaccagagatgaacgcgccgacgctacaaaaattatcacggagaacgagaataccaaccttcggatcaaggcgctcctggccgaaatgatgaatgatgttgagatggaaaacgtgagaccttattctcccatgcaacaggagattctgaaaatctacgaagacggcattctcaagtccgatatcgagattgaggacgatatcctgaaaatcagcaagacagctcagccctcctctagcgaccttaagcgctataaactgtggctcgaacaaaagtacaaatccccttacaccgggcagattatcccgctgaataagctgttcacacccgagtatgaaattgagcatatcattcctcagtctagatactttgatgacagcttctccaacaaaatcatttgcgagagcgccgtcaataaacttaaggacaactatatcggactcggctttatcaaacagttcgggggaaccattgtggaatgtggctttgggaagaatgtcaaagtgttcgaggccgaagagtacgaagattttgttaagaaacactatgctaacaatcggggcaagcgcaacaagctgctgctcgaggagatccccgaaaagatgattgagagacaaatgaatgacacgcggcatatctctaagtacatttccggagtgctgagcaacatcgtccgcgtggaagatggctctgacgagggggttaattccaaaaacatcgtgcctggaaacggcaagattaccacacagcttaaacaggattgggggctgaatgacgtctggaacgaactcatcctgcccagattcgagcggatgaatcagctgaccaacagcacagattttaccgcctggaatgagaaccaccaaaagttccttccgacggtgcctattgagttctctaaaggatttagcaagaagcgcatcgaccacagacatcacgcgctggatgctctcattatcgcctgcgccacaaaagaccatgtgaatctgctcaacaatcagtccgctaagagcgataccaaacggtatgacctgaagaaaaagctgatgaagttcgaaaaagttgtctacaaccacccccagacaggcgaccgcatcgaaagagaggtgcctaagcagtttcttaaaccctgggataatttcacctttgaagccaagaacaatctcgacaaaattatcgtgtctttcaagcaaaacctgcgggtcattaataaggctaccaactactatgagaaatttgtggagaaggatggggttaaaacaaaggaaagagtggagcagaaaggcacgaattgggccatccgcaagtccctgcacgaagagaccgtcagcggaaagattgaccttccttgggtggagacaaacaacggcgagttcatcaccgcgacacggaaatccctggatgcctcttttaatctcgaaaagattaaaaagatcaccgacacggggatccagaaaattctgagaaactacctcaaggctaaagatgacaatgccgaactggctttcagccccgagggaatcgaagatcttaacaagaatattgagaagtataacgacggcaaatcccatcaaccgatcgttcgcgtgcgggtctacgagaaggggaaaggaagatttgccctgggccagacagggaataacattgataagtatgtgcagggctctcctaatctcttctttgcgatctacaaagacgaaaacggaaagaaaagctatgagtccatccgcctggatattgttatcgaacggatgaaacagggcctgcaagccgtgcccgagaccaatcccaacgggatttctctttaccagaatctgagccctctcgacctggtctacatcccgaccgaagacgagattgagagcccccacctcatcgatttcacaatcctgaacaagaccagacttgaacgcatttataatgtgaacgacttctccggatacacaatctatttttctcagaactccttcgctaaaaatatttaccctaaggagatggatatgacgtggaacgaaaagaagcagaagcccagcggctcttttgactccaaaaccgccagctataataagaaatctatcaaggatattttcatcaaactgaagattgaccggctggggaacatctccaaggtgagcaatacactctga

SEQ ID NO: 4550 - RNA, 4401 nt, synthetic construct
  misc_feature 1..4401: note = Cas9 variant
  source 1..4401: mol_type = other RNA
atgaagaacatcctgggcctcgacctggggaccaatagcattggatgggcccttgtgaaagaggatttcgaaaacaagcagggcgagatcctggggctcggatccagaattatccccatgtctcaagacattctgggcgaatttgggcggggaaatagcatctcccagacagctgatcgcacgggctacagaggcgtccggcgccttagagagcggcatctgctccgcagagaacggctgcaccgcgttctgaacatcctcgggttcctgcctaatcactatgccaaagagattgactttaccaagagacttggaaaattcatcaaccatgcggagccgaagctgtcttttgataaggagttcatttttaaagacagcttcaatgaaatgctcaaggattttcagcagaaccaacccggcttcatcattaataaacacggggaagaggctctggtgccttacgactggacaatctattaccttcggaagaaagccctgacccagaagattgataaggaggaactcgcctggatcctgctgaactttaatcagaaacgcggatattaccagctcagaggcgaggaagaggaagagaacacaaataagctggtggagttctattcccttaaaatcattgacgtcatcgctgataacgaagtgaataagaaaggggaggtttggtactctctgcatctcgaaaacggatggatttaccggcgcagctccaagatcagcctggtggactggaaagataaggtcagagactttattgtgaccacagacgttaacgatgacggctctgagaaacttgataaagacggcgtggtcaagcggtccttcagagcccccagcgctgatgactggaccctgctcaaaaagaaaacggaacaagatatcgacaattctaacaagaccgtgggggcctatatctacgagaatctgctgctcaaccctaagcagaaaattaagggaaaactggtgcgcacaatcgagcggaagttctataaagatgaacttaagcagattctggagaagcagaaagaatttcaccaagagctccagaatgaacagctgcttcaagactgcgtcagagagctgtacaagtataacgagcagcaccagcagatgctcgaatccaaagatttcgttcatctgtttctgaatgacatcattttctaccaacgccccctccggagccagaagtctctgatctccaactgtacccttgagaaaagagtgagccgcgacggcgtggtctttcctatcaaggtgatttccaagtctaatccgtattaccaggagttccggctgctccagtggctgcaaaacctggcgatctacagaaaagatgacgatgttaatgtgacacaggaatttcttaacagcattgagtcctgggaaaatctcctgcagttcctgaacgccaagaaagagatcaagcaggaacaactcattaaatttctgcttgagcagaaggggctgaaaggaaatagcctcaagaccgctatcctgacgtatcgctggaactacgtcacagacaaggtgtatcccatgaacgaaacccggtctctgattcaggataaacttaagaaagttgagaatgtggccacagacttcctctcctttgataacgagatggctctgtggcacatcatctacagcgtcaatgacaagattgaatatgagaaagccctggcgaagttcgcctctaagcataacctcgatgaaatcagctttgtggagtccttcaaaaagttccctccctttaaatctgactacggcagcttctccgaaaaggctattaaaaagctgcttcctctgatgagatttgggagcgtctggaataagaacaatatcgtgccctctgttctcgatcgcattgacaaaatcctgaccggagagtatgatgagaagatcaaaattcgggtgagagaaaaggccgagcagttccaactgaaccagatcgaagactttcagaatcttccgctctggctggctcaatacgtcgtgtacgaccggcactccgaggccgaaattgccggcaaatggaacagcgttaaggatctggagaattatctcaaggagttcaaacagcactctctgcgcaaccctatcgtggaacagattatcaccgagacacttagagtcgtgaaggacatctggcagcaatacggcaatggggtgcagaactttttcgatgaaattcatatcgagctgggacgggagatgaaaaatacggctgacgaaagaaagcgcattaccaactccgttacagagaacgaaaataccaacctccggatcaaagcgctgctggtcgagcttaaggaagatacaaatattgagaacgtgagaccccacagccctatgcagcaggagatcctcaaaatctatgaagagggcgtgctgaatgccgtcgaaaacattgacgaggatatcctgaagatttccaagaccgctcaaccctctaaaagcgaactcatccgctacaagctgtggcttgagcagaaatatcagtccccctacacgggggagatgattcctctgtctagactctttacaagcgactatgaaatcgagcatgtgattccgcagtcccggtacttcgatgacagcctgtctaataaggttatctgcgaagccgccgtgaacaaacgcaaggataatcaactgggacttgagtttatcaagaaccaccattccgaaaagattgagctgggcaatgggagaaccgctcaggtcctcgaggtggaagcctacgagagcttcgttaagaaaaactatgacaagaatcggggcaaacgcaacaagctgctcctggaagatgtgcccgagaagatgatcgagagacagcttaatgacacccggtacatttctaaatttgtcacacatctgctctccaacatcgtgcgcaaggacgaagttaacagcaaagatgacggaattaattctaagaacatcatccctggcaatgggaaaattaccagccaactgaagcaggattggggactgaacgacgtgtggaatgagcttatcctgcccagattcgaacggatgaacaatctcacaaactccacggatttcaccagcacaaataccaacggcaagattatccctacagtccccctggagtattctaaagggttttccaagaaacgcattgaccacagacaccacgcgctcgatgctctggtgatcgcccttgccacccgggaccatgtgaatctgctcaacaatgaaagcgctctgccgaagaaagatagaacgaaggaggagcagaagtccttccgctttgacctgcaggtcaaccttcggaataaagaaaagtacttcaacgttaaagagggaagagaaaaggagaaatttaccacattcaagaaaccttggaataccctgacacaagatacccgcgacgccctcgaaaacatggtggtgtcttttaagcagaacctgcgggtcatcaataaggctacgaactattacgagagctatacagacgagaatggcaacctcagactggataaatacgggaatcccaagaaagaacttatttcccagaagggcaccaactgggccatccgcaaatctctgcacaaggagacagtgagcggacagattcacctggaccgggttaaggtgaccaaaggcaagatcgtcaccgcgacaagaaaatccctcgattctagcttcaatgaaaagtccattgagagcatcacggacaccgggattcagaaaatcctgcgcaactaccttaaggccaaggataataaacctgacgtggctttttctcccgaaggaatcgaggagctgaacaagtccattagcgtttataatgaaggcaaaaaccatcaacctatcattaaggtgcggatcttcgagcaggggtctaaatttcccgtcggagaaacaggcaataagattgccaagttcgtggaggctgccaaagggaccaacctcttctttggcatctaccaggataagacaggaaaaagatcctatgacaccatcccgctgaatctcgttattgagcggctgaagcaaggccttagccctgtgcccgaaacgaacgagaaagggcaccagctgctgttccatctctctcccaacgatctggtctacgtgcctacaatcgacgataatgaacagcttgactccaaccgcgtgtataagtttaccgatagctccgacaccacatgtaatttcattccgagcaacatctctgcgattatctttaatatcaacagcaaagagcaggaaaagagaggaattaattaccccatccaaaacgagctgggcgtcgggtcccctcagtctaagaatcagaaatccttcgacggatttatgattaaggaggtttgcatcaaactcaaggtggatcggctgggcaacattagcaaaacctga

SEQ ID NO: 4551 - RNA, 4416 nt, synthetic construct
  misc_feature 1..4416: note = Cas9 variant
  source 1..4416: mol_type = other RNA
atgtgcaagtacttctatatcaaaaactttattaccttcgtgctgagcaagtccatcattcccatgaaacacatcctcggcctggaccttgggtctaatagcattggatgggcctttgtccagcaagatttcgagaacaagcagggcaaaatcatcgctacagggtccagaattatccctatggaccagggcattctgggagattttgaacgggggaatacggtttctcagaccgccgagcgcacaacctacagaagcacacggcgcctcagagaacggcatctgcttcgcagagagcggctgcaccgcgtgctccatatcctgggattcctgccgccccactatgacgcgcaaattgattttaccaagagatacggcaagttcatcgacaacgctgaacctaaaattgcctataataacggcaattttatcttcatgaactcctttaatgagatgatcgaggatttcaagaaacatcagccccagctcttttacaagaaatctaacggggaagagagcaagattccttatgactggacaatctactacctgcggaagaaagccctttcccagaagattacccaacaggaactggcttggctcatcctgcacttcaatcagaaacgcggatattaccagcttagaggcgaggaggaaacggagaaccccaataaggaagtggccttccacagcctgaaagtcgtggatgttgaggctgaagcccctaacaagaaaggggagatttggtataccatccggctcgagaatggatggatctaccgcagaacatctaagattccgctggacgattggaagggcaaaacccgggactttatcgtgacaaccgatctgaacgacgacgggacgattaaggtcgataaagaaggaaaggagaaaagatccttccgcgcgcccgacgaaaacgattggaatctcctgaagaagaaaacagagcatgacatcgattttagcggcaagaccgtgggcgcctatatttacgaccaccttctgcaaaaccctaatcagaaaatcaaggggaaactcgttcggacaatcgaaagaaagtattacaaggatgagctgaaagctattcttgccaagcagatcgctctgcaacccgaactcttcaccgaaaccctgctggccgactgtattcgcgagctctaccggaaaaacgaaacacagcagcagaatctgctttctaaggattttctgcatctcttcgtggaggacatcattttctatcaaagacctctgcgctccaaaaagagcacgatcgcgaactgcacccttgaaaagcggtcttacattgataaagagacaaatgagagaaaggacgcccccatcaaagtctgtgctaagtccaacccgtattaccaggaatttcgcgtgctgcagtggctccagaatctgcggatctatgagattgaaaccgacagagaggtgacagccgagtttatcgaaacccctcaagattgcgaggctctgttcaactttctcatgagccagaaagaaattgacaataagggactgcttaaatacttcctgtttgccaagaacccccagatcaaggataaagccgctaagtccgagctcaaaaagtggctgacgacatatcgctggaattacgtctacgacgcggccgataactctagcaaaaagtatcctatgaatgaaaccggctacgagctgcagcggtatcttcaaaaggttgaggggctccccgctaacttcctgaccttcgacattacataccagctgtggcacctcctgtattccgtgaaagataaggtggaatttgagaaagcccttaagaaattcgccaagaagaaacagctggacaagaccagctttgtcgattctttcaaaaactttaagccctaccctaatgaatatggatccttcagcgagaaagctatcaagaagctcctgccgctgatgagatttggcaaccactgggacttcaatcggatcgatgtgtctacacagaaacgcattgacgatcttatcaacggggttgccaatgaagacattagaacgatcattcgggagaaggcggagaaataccaactcaacagcgaaacctgttttcaggacctgcccctgtggctcgctcagtacgtggtctataatagacatgccgaggccacagatatcgaaaagtggacctccgtgtctgacctggaggcttaccttgaagatttcaaacaacacagcctgcgcaaccctatcgttgaacaggtggtcacagagaccctccgggtggtcagagacatttggcagcagtatggaggcggccaagccaatttcttcgatgaaatccatattgagctggggcgcgaactgaagaaaacggctgaggagagaaagcagctttccgacaagaaccaggaaaatgagagcaccaacctccggatcaaaaagctgctggccgaactcaaagaggatgcgtctattcagaatgtgcgcccctactccctggttcaacaggaacttctgaagatctatgaggagggagtgtttagcgccacagacgaagtcgaggaagatatccagaaaattagaaagaaggctgagccttctaaagccgacctccagcggtacaagctgtggctggaacaaaaatataagtccccctacaccggcgaggtgatcagccttacaaaactcttcaccgaggaatacgagattgaacacatcattccgcagtcccgctattacgatgactctctgagcaacaaggttatctgcgagtccgctgtgaataagctgaaaacgaaccagctcgggctggaatttattcaaaaccatcacggagagaaggtcagaatcacagccaataaagaggtgaccatctttacagaggagcagtataaggagttcgtgaaaaagcactacgcgaacaattctgccaagcagcagaaacttctgctcaacgagattcctgagaagatggttgctcggcaactgaatgatacccgctatatcagcaaatacatttccgaaatcctgagcaagattgtcagatctgacgagaaagacgaaggcgtgaactccaagaatatcatcccctgtaccgggaagattacaacggcccttaaacaggattggggcctgaacgacgtgtggaataagctcatcctgcctcggtttgagcgcatgaaccagctcacccagacacaactgttcaccagctataatgatagacttcagaaaaacctgcccacagtccctattgaatactctcagggatttcagaagaaacggatcgaccatagacaccatgctatggatgccctcgtgattgcctgcgctacccgcgagcacatcaattacatgaacaatcaacacgcgctggacaagtccaaagataagaaggagaaacagcagagccggatcgacctgagaacgattctttgtgaaaagaaaaacaacaattggcagttcaagaaaccctggtctacatttacccaagaggccaaggaagctctggagcatatcgttgtgagcttcaagcagaacctccgcgtcattaataaagccaccaactattacgaaaagtgggaggagaaaaatggcgtgctggttaagaaaaaggtgaagcaggaagggacaaactgggccatccggaaaccgctccacaaggagaccgtctccggaaaaattgtgctggatagaaagatcggcaaagacaagattcttacagctacgcgcaaggccgttgatatcacctttacagagaaaatcattagctctatcaccgacacagggattcaaaagatcctgctcaattatctgaaatacaagggatcccctgaagtggcgttcagcaccgaaggcctggaggagcttaacaaaaatattgctcagtataacaatgggaagaaacatcagcccatctacaaggtccggatctttgaagagggctccaagttccccctgggagaaacgggcgccaaagccaccaagtatgtggaggctgccaaagggacaaacctcttctttggagtgtaccagggcaaggggaaaagaacctacgcgacaattcctctgaatgaggtcatcgaacgccaaaagcagggactcccgtctgttcccgagcggaacgaaaagggcgagcctctgcttttcagcctgtcccccaatgacctggtgtatgtgcctatggaaggggagattgctgagaccatcgattttaacaatctctctaaagaacagaaggagagaatttacaaaacagtcagcttcaccggcaaccagtgctttttcgtgcaagaagccgttgccacgcccatcgtgaacaagatggagtattcccctctgaataaaatggaacgggacatccttggaacaatgattaaggaggtctgtatcaagctgaaagtggatcgcctcggcaacattaccaaggcttga

SEQ ID NO: 4552 - RNA, 4416 nt, synthetic construct
  misc_feature 1..4416: note = Cas9 variant
  source 1..4416: mol_type = other RNA
atgggctacaaggcccccagaaacgacaaaggggagatcgattatggagtgggcctggacctcgggaatggaagcgtcggctgggttgctatggataaggactaccacctgattcgggcccgcgggcatgaacttatcggagcgagactgttcgatcctgctaactccgccgagaatcggcgcgaatctagaaccacacggcgcagactcagccggcgcagatggcggctgcgcatgcttgactccctgtttgcctctgagctcgctaaaattgatccgaacttcctggccagacggaagtatagctgggtgcaccccaaagacgaacagaatcatgagaactggtacggctccatcatttttggctctaaggagcaagataagcagttctataaagactaccctacgatctatcatctgcgcaagaaactcaccgaagatacagagagacacgacatccgggaaatttacgtggctatccaccacattgtcaagtacagagggcattttctgcgcgagggagagatcaatagcgaaaaccttttcgatcccgagggctttgtggaactgattaaagacgttatcaagctcaataactcctatgacgagagcacccctattttcgaagcctctcccgcggatgtgtccgaggccctgcttaatgagcacacaagccggtctgggagaatcgaagacaccctggataagctcgacttttccgtcagccgcgtggataaacatgagctgaagggaatgcgggacgctgccaaagctgttatcggcgccattgtggggaacacagcggatttctctaagatctttaatctggacaacctcgataaagactccaaggataatctgaaacttaagttcgccgacagcaactttgacgaaaagtacggaggcgtcgtgggctccgggctgctcgatgagacccagattgaactggtggacagaatccacgctgtctatgatgccgttgctcttaaaggcattctgggagacgcccacacgatctctgaggccaaggtggagagctacgaaaaacatcgcaagaactggaaactcatcaaggaggaactgcggaccaaggagaataaagatgaagtggacctgtggtatggggatctctccggaagacagtacaagaaccctccggaccccgagaaaggccctgatgaggggagcaagaaagactctcccattcgcgattccgaccaaaagcagaatctgatcaagaaagctaacgattatttcacagaacttattgacgacagccagctgtctgaggaacagaagaattgcctcaaaaacgatatcaataacggacaactgttccctgtccagcggagctccgacaatggcgtgattccctaccagatccaccttaacgagctgagacgcatcattgagaatcagaagcaatactatccgtttctcgcggaaaccttcatccggaaaacagccgagggcaagtcttacgaagagaacaagattgttgctctgctgaaatttagagtgccttattacgtcgggcccctcgtgagcaaggaagatatggaggagcattccagcggaaattctgcctatcactggatggcccggaaccctggccgcggggaagctatcaccccctggaatttcgacgaggttgtggataaagacgaatccggagccagatttattagccggctgacgggcacagatacctaccttctgggggagcccacactccctcagcattctctgctgtatgaagagtacatggtcctttccgagctcaacaacgtgagactgaatgtccgccagggcaaccactggagcgacaagaatcggcaaagactgtcctacaaacagaaggagttcctcatcgaaaacctgtttaaagaacacaagaccgtgacccgcaagagagcggaggattgtctttctagcatgggatgcggcgaagttcagctgttcgggctctccgacgagaaaaagtttgcttctagcctgtccagctatattacactgaaaaagatccttggaaaagccttcgtggatgactctggcaattccgccatcctcgagcggattatcgaagtccagacggtgtttgaggatcgcgaaccgctgacccatcaactgagcctcattgactctctgacagttgagcagagaaagcagcttgctaagatccactacaccgggtggggaaaactgtcccggaagctcctgacaagcaaaaagggctcttataaaattcatagccagaacgagatcatgcgcacccaacactccatcattgacatcatgagaggggatagcctgaatcttattgaaatcattcgggacaagaagatcggcatcggagagtggattgataacgaaaatctcgaccgcgagacgggcgaatctgatgtgtccagactggagagcgtcttcgaggggatcgtgatgtctccccgggtgaaacgcggagttgtccaggccgtgagagtgattgacgatctggctaaggccatcggcaaccctccccagcggatttttatcgaaatggcggacgaggtccaggcctcccaaagaacagtgagccgcctctcccggctgaaagctctttacgggtctcctagcctgcagaaggagttcaatgatctcaaagacctgagaaagtccctgaacgaaaccaaggatgccgaccttcaggaagaccgcctctatctgtactatatccagctgggaaaagatctctacaccggcaaggagatttctatcgacagcctgtccagcgcttacgatattgaccacatcgttccccaagcccttacacaggatgactctattgataatcgggtgctggtctccagaaaagagaacgcgcgcaagaccgacagctatctctacacaccggatctgatcaaaaatatgcggcctctgtgggggaaacttctggccgctggcctcatgtctcagaaaaagtatgacgccctgacgagagtggatgacttcaaggatcgcgaaaaacaacggtttgttcagagatccctcgtggagacccggcagattatgaagaacgtcagcacaatcctgcgcacctactatggagaagacacaaacgtggttacccttaaatcttccatcacgcatgacatgagaaagtacctgggcttcccctataaaaatcgggatattaacgactaccaccatgctcaggatgccctctgtatcagcgccgctgggcaatttatgctgaatcgccacttcgtgtccggaggcgaggtcaccgacggggcgagcaacgcctacaatatgtatctggctgaataccttcaggagtttagagatgccaaggcccggggagagagaaagcgctctacagctttcggctttgtggtggggagcatgtcctctaaagacgatgaaaagcggaccgaccatagaacaggcgagattgtctggagcgaaaccaacgccgagtatctgcgcaaagttatgaattacaagaaaatgctcatcacgcagaaggtgggagatgtgaagacacgggcgctgtatgacgagaccagatacggccacaaagaatcctctgctaagagcattaaattcgataacctccgccgggacacatccctgtatgggggattttctggcgccagcaccgcctacatgatgcttgtcgagtacaagaaaaagaataagctggtgtccatcaccgctcaggaagccagcctcctggcggttgctgatcaaaagaacgacacagtgtctgtcatggacgggatcctggcctcccacggacttagcggcgccaagattctgctccctaaaatcgtgacgggccagctgctcgattattctgacgctctggttacccttcagtccgccagcgagctgaatacagctagacagatgtggctgccccgcaacgattacaatgacattgatatcattctcaagtccaaagacatcgaagatgccgcgcataagctggggtatgactctgataccgtgcacgtccttagacggatccaaaagctgttcgaggccgtgtttcgcgttgctgagagccagttccctctccatcagctgtccaaagaccaacaggaagagattctcagagatccccagaactacggatttggcagcgccgtgaagctgcttgggggactgctgaaagctctccacgccaatgccgaaaacacaaacctggctggccttgtcaaggtgctgcatggggacaaagagtattctgacgatggaaaggcgaaagagttcaagaagttcggcttttccccgcggtggcgcagaatcagcaatcctaccggcttcacgctctctgacagcgatacatttatttaccagtccccctctgggatcttcgaacaacgggtgaccgtcaaagagctgaaggaaaaagccgacaagcagaaatga

SEQ ID NO: 4553 - RNA, 4422 nt, synthetic construct
  misc_feature 1..4422: note = Cas9 variant
  source 1..4422: mol_type = other RNA
atgaagaacatcctgggcctcgacctggggaccaatagcattggatgggcccttatcgagaaagatacagaccagaagaacggcaatattctggggacgggatccagaatcattcccatgtctcaagatatcaaagacgaatttggcaaggggaacagcatctcccagaccgctgatcggacaaaatttcgctctgtgagacggctccgcgagagacatctgcttcggcgcgaaagactgcaccgggtcctcaatgttctgggattcctgcctaagcactacgccgaccagattgattttaagaaacgcctcggcaagctggtgaacgagaccgaaccgaaacttgtgtatgacaataagaacttcatctttaaaaagagcttcgaggcgatgctgtccgattttaatcagcatcaacccctcctgcttgctgacggcaagaaagtccctttcgattggacaatttactatctgagaaagaaagccctcaccgagaagatcgaaaaagaggaactggcctggctgattctcaactttaatcagaagcgggggtactatcagctgcgcggagaggaggaagaggaaaaccccaataaaatggtggctttccactctcttaagatcgttgaggtgattgccgacgaaagccagaagggcaaagctgagacatggtactccctgatcctcgagaacgggtggatctatagacggagctctaagacccctctgtacgattggaaaggaaagcaacgcgactttattgtcacgaccgaccttaatgatgacggctccatcaaaacagataaggaagggctggagaagcggagcttcagagcccccgtggaagacgattggaccctcgttaaaaagaaaacagagcaggaaattaacagatctcataagaccgtgggaacgtacatctatgagaacctgctgcaggaccctaaacagaagattaagggcaaactcgtccgcacaatcgagcgggaattttacaaggatgagctgaaaatgatccttaagaatcaacagaaattccacccggaactgaacgacgagcacctctatattaattgcgtgagagaactgtaccgcaacaatcaggcgcatcaaaccatcctttccaagaaggatttcgtgcacctgtttattgacgatatcattttctatcagcggcccctcagaagccagaaatcttccatcagcaactgtacactggagtttcgcaagtacaaaaatgagaacggcaccgaccagaccgactatctgaaggccatccctaaatcccatcccctcttccaagaatttcggctgtggcagtggatttacaatcttgggatctaccagaaggaggatgacacaaacgtcacggatgaactgattaaaaatatcgacggatatcaggatctcttcgactttctgaacaataagaaggagattagacaagatatcctgattaaattccttgttgagcagaccggcctcaaggggaaacctctgtctagcgtggtggctaagtaccgctggaactttgtcgaagacaaaatctatccctgcaatgagacaggaacccagatccggacaagactggccaaggtggaaaacaccccggaggatttcctcacggctgaaacagagattaagctgtggcacatcatttactccgttaacgacaaagccgattatgagaaggcgcttaaaacctttgccgaaaagcacaatctggacacccatagcttcgtggagaactttaaaaagttccctcccttcaagtctgaatacggctcctttagcgagaaagctatcaagaaactcctgcctctgattcgccttgggaagtattggtcttgggaaaatatcgataaaaagacacaggagcggatcgagaagattctcaccggagagttcgacgaagccatcaaaagcagagtccgggacaaggctattcacctgacagaagaggatcattttcaaggcctgcagctctggctggcctcctacgtggtttacggccgccactctgaagccgacaaccttgataaatggcatacggtggctgacctggaggattatctcgcggagttcagacagcacagcctgcggaatcccatcgtcgaacaggtgattaccgagacactgagagtcgtgaaggacatctggcttcaatacgggcagggagccaaagatttcttctccgaaatccacattgagctcgctcgcgagatgaagaacaccggcgacgaacggaaaagactgacaagcctggttaccgataatgagaacacgaatctccgcatcaaggtgctgctttctgaactgctcaacgacgggaatgtcgagaacgtgagaccctattcccctatgcagcaagaagccctgaagatttttgaggatggagttctgaatagcgacatcgagattgaagatgacatccttaaaatctctaagatggcccagccgaccaacacagagctcaaacggtacaagctgtggctggaacagaaatatcgctccccctacaccggccagattatccctctcaatagactgttcacagctgactatgagattgaacatatcattccccaaagccggtttttcgatgactccttttctaacaagatcatttgtgagagcgccgtgaaccagcttaaggataaacagctggggctcgagttcatcaagaatcactccggcaccatcgtcaaactgggaatgggcaagacggcgaaaattctggacgtggaatcttacaacgagtttgtgaaggggaattacacaaagaacatcagcaaacgcaataaacttatgctggaagagattcctgataaaatgatcgaaagacagctcaacgacacccggtatatttccaagttcatcatcagcgctctgtctaatattgttcgctccgagagcaacgatgacggattcaattctaaaaacgtcctccccggcaatgggaagatcacatccagactgaagcaagattggggaatgaacgacatttggaatgagcttatcctgccgcggtttgaacgcatgaacaaaattaccgatagcgccgtgttcaccgcctggaatgagaacaaccagaagtttctccctatcgtgcccctggagttctctaaaggctttcagaagaaaagaatcgaccatcggcaccacgctctggacgcccttgtcattgctgccagcacaagagaacatatcaatctgctcaacaatgagcacgcgaagtccgataagcgcttcgacctgaaccggaaactcagaaagtttgaaaaagtggcctacaatgatcctaagacggggaaacgcattgagaaggaagttcccaccatcttcctgaaaccttgggagacatttaccgtggacgctaagaacagccttgaatctattatcgtctccttcaagcagaatctgcgggtgattaacagagccacaaattatagcgagtcctacaacgatgagaatggcgctctccgcctgggaaaagacggcaaccccctgaaggaaaagatcaagcaatctaaaggggatagctgggccatccggaagccgatgcataaggactttgtttatggaaaagtgcaccttcagaatgtcaagctgcctaaagataagttcattaccgcgatcagaaaatccctcgacgtgacgttcgatctgaagcgcattgagacaatcaccgacaccggcattcagaagatcctcaaaaactacctgcattctaaggaaaataaagttgagcttgcctttagccccgaagggatcgaggatatgaaccaacacattgagcggtataatgacggaaagaaacaccagcccatccataaggtgagagtcttcgaaattggctcccggttttctctgggggagagcggcaacaagaaaacaaagttcgtggaagctgccaaaggaaccaacctgtttttcgctgtgtaccaggacgataataagggcaaacgcaactacgagacaatccctctcaatattgtcatcgaaagacagaagctggggcttcactccgttccgacggaggacgccaaaggaggcaagctgctctttcatctgagccccaacgatatggtgtatgtgcctacctctgaggaactcgaggacaatctggcctccgtcaacatcaagcggcttaatacagctcaacgcaaaagaatttacaaggtggaaaaagcgagcggggttgagtgctatttcatccggcaggatattgcctacctgatcaagaactatgacgctaaaaccaagattggagagctggaatctcagaataagctccagacaaccatgacggatgacagactgaaaatcaccgatgtgtgtgtcaaacttaacattgaccgcctgggctccatcgccgagacatttctcgggaatcaatacggcgccagcaagaagacctga

SEQ ID NO: 4554 - RNA, 4422 nt, synthetic construct
  misc_feature 1..4422: note = Cas9 variant
  source 1..4422: mol_type = other RNA
atggccaagatcctgggcctcgacctggggaccaacagcattggatgggctgtggtcgagagagaaaatatcgatttctcccttattgacaaaggcgttcggatcttttctgagggggtgaaaagcgaaaaaggaattgagtcctctcgcgccgcggaaagaacaggctaccggagcgctcgcaagatcaaatatagacggaagctgcgcaagtacgagacgctcaaagtgctgtcccttaacagaatgtgccccctgtctatcgaggaagtcgaggaatggaagaaaagcgggttcaaggattatcctctcaatccggagtttctgaaatggctgtccaccgacgaggaaagcaacgtgaatccctacttctttcgggatcgcgcctctaagcacaaggtttccctcttcgagctgggcagagccttttatcatattgctcagcggcgcggattccttagcaacagactggaccaatctgccgaaggcatcctcgaggaacactgtcctaaaattgaggctatcgtggaggatctgatttccatcgacgaaattagcacaaatatcaccgattactttttcgagacagggatccttgactctaacgaaaagaatggatatgccaaagatctggacgagggcgataagaaactcgtctccctgtacaagagcctgctcgcgattctgaaaaagaacgaatccgactttgagaattgcaagtctgagatcattgaacggcttaacaaaaaggacgtgctggggaaagttaagggaaaaatcaaggatattagccaggccatgctcgacggcaattacaagaccctggggcagtatttctactccctttatagcaaagagaagatccgcaaccagtacacatctagagaggaacattatctgtccgaatttatcaccatttgtaaagtgcaaggaatcgatcagattaatgaggaggaaaagatcaacgagaaaaagttcgacggcctcgctaaggatctgtacaaagccattttctttcagcggccccttaagagccagaaaggcctcatcgggaagtgctctttcgaaaagagcaagtccagatgtgctatctctcaccctgactttgaggagtatcgcatgtggacgtacctgaacaccattaagatcggaacacaaagcgataaaaagctgcggttcctgacccaggacgaaaaactcaagctggtccccaaattttacagaaagaatgatttcaactttgacgtgcttgccaaagagctgattgaaaagggctccagcttcgggttttataagtcttccaaaaagaatgatttcttttactggttcaactataaacctacagacaccgtggcggcctgccaggtcgctgccagcctcaagaatgctatcggagaggactggaaaacgaagtcttttaagtaccagacaattaactccaataaagaacaagttagccgcaccgtggattataaggacctgtggcatctgctcacagtggccacctccgatgtctacctgtatgagttcgccatcgacaaacttggcctggatgagaagaacgctaaagcgttctctaagaccaagctcaaaaaggactttgccagcctgtccctgtctgctattaataaaatccttccgtacctcaaggaagggctgctgtacagccacgccgtgttcgttgccaacatcgagaatattgtggatgaaaacatctggaaagacgagaagcagcgggattatattaagacacagatctccgaaattatcgagaattacacgctcgagaaaagcagatttgaaatcattaacggactgcttaaggagtataaatctgaaaatgaggacggcaagcgcgtctactattccaaagaagctgagcagagcttcgagaacgatctgaagaaaaagctcgtgctgttttacaagtctaacgaaatcgagaataaagaacaacaggagaccattttcaacgagctgcttcccatctttattcagcaactcaaggactatgagttcatcaaaatccagcggctggatcagaaggttctgatttttctcaaaggcaagaatgaaacagggcagatcttctgtaccgaagagaagggaacagccgaagagaaagagaagaaaattaagaacagactgaaaaagctgtaccacccttccgacatcgaaaagtttaaaaagaaaattatcaaggacgagttcggcaatgagaaaatcgtgcttgggagccccctcaccccttctattaagaaccccatggcgatgcgcgctctgcatcaactgcggaaggtccttaatgccctcatcctggaaggacagattgatgagaaaacgatcattcacatcgaaatggccagagagctgaacgacgctaataagcgcaaaggcattcaggattaccagaacgacaataagaaatttcgggaagatgccatcaaggagatcaagaaactctatttcgaagactgcaagaaagaggtggaaccgacagaggatgacattctgagataccaactttggatggagcagaaccggagcgaaatctatgaggaagggaagaatatttccatctgtgatattatcggcagcaaccctgcttacgacatcgagcataccattccccgctctagatcccaggataatagccagatgaacaaaaccctgtgctcccaacggttcaacagagaggtcaagaaacagtctatgcctatcgaactcaataaccacctggagattctgccccgcatcgcccactggaaggaagaggcggacaatcttacacgggaaattgagatcatcagcagatccattaaggccgctgccaccaaagagatcaaggataaaaagattcgcagacggcattatctcacactgaaacgcgactacctgcagggaaagtatgacagatttatctgggaggaacccaaggtgggcttcaaaaactctcaaattcctgatacggggatcattaccaagtacgctcaggcctacctcaaaagctattttaagaaagttgaatccgtgaagggaggcatggtcgcggagttccggaagatctgggggatccaggaatcttttattgacgagaatggaatgaaacactacaaggtgaaagatcgcagcaagcatacacaccataccatcgacgccattacaatcgcttgtatgaccaaagagaagtatgatgttctggcccacgcttggacgcttgaagaccagcaaaacaagaaagaggccagatccattatcgaagccagcaagccgtggaaaaccttcaaggaggatctgctcaaaatcgaagaggagattctggtgtctcactacacacccgacaatgtcaagaaacaggctaagaagatcgtgcgggtgcgcggcaaaaagcagtttgttgcggaagtcgagagagatgtgaacgggaaagccgtgcctaagaaagctgcctccggcaagaccatttataagctggacggagaaggcaaaaagctgccccggcttcagcaaggggatacaatccgcggaagcctccatcaggactctatttacggcgccatcaaaaatcctctgaacaccgacgagatcaagtatgtcattagaaaagatctcgagtccatcaaggggagcgacgtggaatctattgttgatgaggtggtcaaggagaaaatcaaggaagctattgccaataaagtgctgcttctgtccagcaacgcgcagcagaagaataaactcgttggaacggtgtggatgaacgaagagaagcggatcgctattaataaggtcagaatctacgccaactccgtgaaaaaccccctgcacatcaaggagcatagcctgctttctaaaagcaagcacgttcacaaacaaaaggtgtacggccagaatgacgaaaactatgccatggctatttacgagctggatgggaaacgcgacttcgaactcatcaatatttttaacctggccaagctcatcaagcagggccaaggattctatccgctgcataaaaagaaagagattaagggcaaaatcgtctttgtgcctatcgaaaagcggaataagagagatgtggtccttaaacgcgggcagcaggttgtgttctacgacaaggaggtggagaaccccaaagatatttccgaaatcgtcgacttcaagggacggatttatatcattgagggcctgtctatccagagaatcgtgcgccctagcgggaaagttgatgaatacggagtgattatgctccggtattttaaggaggcgagaaaggctgacgatatcaaacaagacaatttcaagcccgacggcgtctttaaactgggggaaaacaagcctacacgcaaaatgaatcacaaccagttcaccgcctttgtggagggcattgatttcaaggttctgccctccggaaagtttgagaaaatctga

SEQ ID NO: 4555 - RNA, 4425 nt, synthetic construct
  misc_feature 1..4425: note = Cas9 variant
  source 1..4425: mol_type = other RNA
atgaagaaaatcctgggcctcgacctggggaccaacagcattggatgggcccttatcgagtccgatttcgaaaagaaacagggcaagattaatgggctgggatctagaatcattcccatgagccaagacatcctcggcaaatttgattccggggtgtctatcagccagacagctgagcggacgtcctaccgcggagtcagacggctgaaccagcgcaatcttctgagacgggaacgcctccacagagttctgaacattctggacttcctccctaagcattattctaatgccatcgattttgagaagaaactgggccagttcaaggaaaacgtggaggagaaacttaattacgcgaagaaccaaattggccggcacgaatttatcttcatggacagctttaaagagatggtgaaggagttcaagcagacccagccgcagctgttttataaacgcgaaaatgggattgagacaaagatcccctacgattggaccctctattacctgagaaagaaggctctttcccaaaagattaagaaagaggaactggcctggatcatcctcaacttcaatcagaagcggggatattaccagctgcgcggcgaagacgtcctggatgagagcaagattgaagacttttactctctcaaagtggttgaggtgcaggagacagaagataagaacgccagagggacctggtataatgtcatcctggagaacgactgggtgtacaaacggcaatccaaggaaagccttgataattggattgggaaaaacaaggagttcatcgttacaaccaacaaggaaaaagacggctctctgaagctcgacaaagctgggaatgtgaagcgcaactttagagccgtcgattccgagaaagactggattgctatcaagaagaaaacggagcaggatgtggaaatcagcaagcataccgtgggacagtatatttacgagacactgcttcaaaatgccaaacagaagatcaaaggcaagctggtcaagaccattgaacggaaattctataaggaggagttcatcaaaattatcaaggaacagctcaaacaccatcctgagctgcagtctaagacactgtacgaaacctgcatccaagagctctatcccagaaacgaagcgcaccagaataacattaaatccaagggctttgagtacctgttcacggacgatatcattttctaccagcgccctcttaagagcaaaaagtccacaatctctgggtgtcagtatgagacccggctgttcaaaaagacagttctcaataaagtgaccaacaaggaaaatgagatttggcaaaaggaacccctgaaagccatcagcaagtcccaccctctttttcaggagttcagactgtggcagtttctcaaaaacctgaagatttaccagaaagaagacgtgaagggaaatctgatcgatcatgacatcaccagcgatctcctgaagacagaggctgactgggtcgagcttttcgattttctgaacattaaaaaggaaatcgagcaaaaacagattatccagttctttattaataacaagcagatcgaaaaaggcaagaagaataactatcgctggaactacgtggaggacaaaaagtatccgtgcaatgaaacgaaatctcaactcatctcccggctgaagaaagttaagaacctggaccttaatctcttctttaccagcgagacagagctgaaactgtggcacattatctactctgtgaaggataagattcagtatgaaaaagccatcaagaacttcgctattaaaaataacatcgacatcgatagcttcgtcgagaattttaagagatttcccccttttaaaaacgaatacgccgcgtactccgagaaggccattaagcgcctcctgccccttatgcggatgggggaatattggaatgagtctgagatcaaacaggaagtgaaggacagagcttacagcattatcgagcgcctgaaaggaattgatttcaacaaggacaaaatcgatgaaaagatcaccgacgatgacattaagaaacaactcctgaagtcctttatcgatttcaaagacaagaatcctctgaaaggccttaacacatatcaggcctgttacctcgtttataatcggcatagcgaggtgaactctattgcttactggaagtcccccgatgacatcaataagtatctggaggggtttaaacagcacagcctgagaaacccgattgtcgaacaggtggtcaccgagacgctccgcacagtgcgggacatctggcaatactacggaaagggcaaagcctctttctttaacgaaattcacgttgagctgggcagagaaatgaagaatcctgcctataaacggaaggcttccaccaaccgcgtgaccgagaatgagaacacaaatcatagaatcaaggaaatccttaaagagctgcagaacgaaggggtccaggaggttaagagctactcccggaatcagcaagaaattctcaaaatctatgaggagggaatttaccagtctatcgatgtggtggacgatgcgattgaaaagatcagaaagaacagctcccccaccaaggccgagatcattaaatataagctgtggctggaacagggctacacatctccttatacggggaagaccatccccatgagcaaacttttcacaaccgactaccagattgagcacatcattccccaatccctctactttgataatagcctgtctaacaagatcatctgcgaatccgaggtcaatcagctgaaagacaaccagacagcttatgagttcattaagaaacatggaaccgaaaaggtgagcctcggcaagaataaaacggtggagatctttaccctggaacaatacgagaagcactgtaaccagtatttcaaaaagaataaaaacaaacttaagaaactgctctctgaggaaattcctgaggggttcatcaaccgccagctgaatgattcccggtacattagcaagtttatcaaaggcctgcttggaaacctcgttagagaagaggacgaacaggaggtcacaaccaagcatattgtgccggtgacaggcgccatcacctctaaactgaagcaagattgggggctgaatgacaagtggaacgagctcgtcgccagccgcttccagagactgaatacgatgacaaactccaataactttggatattgggataccaaaatcaatgctttccgggtgcaggttcccgacgaaattagcaagggcttttctaaaaagcgcatcgatcacagacaccatgcccttgacgcgctggtgattgcttgctgtacacggaaccacatcaattacctcaacgccctgaatgccgagaaaaagaactatgggctgcgcgaccttctgctcattaaaaatgataagaaccattacaccaagttctttaaacacccttgggacggattccccgtcgaagctaagtccgtgctggagaaaaccatcatcagctttaagcagaatacaagagttattaacaaaacgaacaataagacctggcaatgggccgaaaaggagggccagctcaaaaaggtgctggtcaaacagacaaagggggataactgggctatccggaaacctatgcacaaggagaccgtgtccggcaaacttaatattcccacaccgaaaggaaagatcgccaccgcgtctcgcgttagcctgtccgaaattaaaacgagaaagcagctcgacaaaatcacagatatctctattcaaaagatcctggagcggcatctgaacaattaccttgacgataagggcaaagaaaagttcgacctggcctttaacgctgatggggtggaggaactcaataaaaacattaaggtcctgaataaaggaaagaaccaccagcctatctataaagtgcgcctctacgagattggcagcagattcaaggtgggaaattccggaaacaagaaagacaagtatgtcgaggccgctaaaggcaccaatctgttctttgccatctaccttaacgaaaaggataaaaagcgggtttatgagaccattcccctgaatgaagtgatcgagcatcagaaacaggtgtctaacctccctaaaaacgagagaacacccgtccctgtgaatcacaccaaggggaaattcctgtttagcctgtcccccaacgaccttgtttacgtgccgacagacgaagagatcgataatcctagcctggtcaacttcaataacctcaataagaaacaagtggaaaagatttataagacggtttcttgctccacctaccagtgctttttcgtgcataacacaatcagcaaacccattcagaataaggtcgagttttctgcgctgaacaaaatggaaaagtccatcgacggcattatgatcaaagatcgctgttggaagctcaagatggaccggctgggaaatatcattagcgtgatcagatga

SEQ ID NO: 4556 - RNA, 4443 nt, synthetic construct
  misc_feature 1..4443: note = Cas9 variant
  source 1..4443: mol_type = other RNA
atgaagaccatcctgggcctcgacctggggacaaacagcattggatgggccaaagtgtgcgtcgataatgacggcaactaccttagagatatcaagctggggtcccggattatccccatgtctcaggacacgctcggaaatttcgataaaggcgttaccgacagccctacagctgcccgcaccgggtttagaggagtgcggcgcattagagagcgggcgctgcaacgcagagaacggcttcaccgcgtgctgcatgtcatgaagttcctcccgccccactatgagaacgctatcggctggaatagagaagaggccacaacctacggcaaatttctgaaccatggggaacctaagctggcctgggagaagcaggaggatggatccatgcggttcctctttatggactctttccacgaaatgatggctgattttgccgagagccagcccggcctggtggctgggggaaagaagatccctcttgactggacactgtattacctccgcaaaaaggccctgacccaggcgattagaaaagaagaacttgcctggatcctgctcaatttcaaccaaaagcggggctattaccagctgcgcggggaggaagatgaggaaaatcccgctaagagagaggaatatcatgagctgaaagttgtgtccgtcgaggccgctgaagagggaaagggcggcaacacgtggtacaatgtgaccctcgaaaacgggtggatttaccggagacagtctaaagttgagctgcacgactgggtgggaaagacacgccagtttatcgtcaccacagaatatgagaaagatggcgtgaccattaagaaagacaagaatggggaggtgaagcggagcttcagagccccttccgaagacgattggggacttcgcaaaaagcggacggagagcctgctcgaagactctggcaaaacagtcggggcgtttatctacgatcacattctgtccgagccgaccgacaagatcagaggaaacttcatccgcacaattgaacggaaatattacaagaaggagcttgaggccatcctgctcgaacaaaccaaacatcacaaggagctgaaagatcagaataccctgattgcttgtatcaaggaactctatcagagcaacaaaccccatcaggactctctgatgaagaaggatatgacataccttctgattacggacctcatcttttatcaaagacctctgaaatccaagaaaagccttatcgccgattgcccctacgagtactatgagtacaccattaaggaaacaggcgagatcaaacgccagggcattaagtgtatcgctaagtctaacccttattaccaggagttccggctgtggcaattcattatcaatctcagactgtttgaccgcaccgatgacaaagaggttacatccgaatatctgagctccatggaggactacaccaagctctttacgtatctgaacgatcggaaagacatcaatcaggagacacttctgaaggatttcttcaaacagaagaaagtgaagatggggatggaaaaggagtttcccattagatggaactacatcgaagacaaagagaagaaatacccgtgcaatgaaacccggcacgagctcctggccgccctggataaggctggaattgaccactcttggcttgatgacaaagagcgcttctatagactctggcatctgctgtacagcgtggaatccaaggaggaagcggagggcgccctccggaagctgaaagataacgacgattttgtcaatgctttccttaaggtgaaaccttttaagaaagactatggggcctacagcgaaaaggccgttaagaaactgctcgctatcatgagaatgggaggcctgtggaacgagaccgatatttgtgagcagacacgcaatcggatccaatctattatcaagggggaaatcgacgagaaaattaaggaaagaatgggccgcaccttctgccagctgtccgactttcagggacttcccgagtggctcgcctgttatgtggtctacggcagacacagcgaggcgacagatatccagcggtggacgaaacctgaaaacctgatggcttatattaatgggttcaagcaacattctctgcgcaaccccatcgtggagcagtgcattctcgaaaccctgagaacagttcacgacatctggaaggaggccggacatatcgatgaaattcacgtggagcttggccggagcatgaaatccaccgccgaccagcgcgctagaatgtctaagagcatcctgcagaatgagaacacaaatctccggattaaatccctgctgatggaacttaagaacgccaaagagatcgaaaacgtccgcccctacagccctatgcaacaggagattctcagaatctacgaagagggggctctgcaggagctgaccaaggaagatgcccagtatccggagatctctaaaatttcccaaatggcgcagcccagcgccaaggaactcctgaagtaccggctttggctggagcagaaatattgttctccttacacgggaaagcccatctccctcagcaaactgtttacctccgcttatcaaattgaacacatcattcctcagtctcgctacttcgacgatagcttcacaaataaggtgatctgcgagaccgaggtcaaccagctgaaatccaatatgcttggctatgaatttatcaagaagcattctggggagattgtgcactgtacaaccatcggcgacgttaaaattctcgatgccaaggaatactacaacttcgtgacggagcattatgctaataacagacggaaaaaggagaaactgctgctcgaagacatcccccaggagtttctgaatagacaaatgaacgatagccgctacatttccaagaaggtcatggccatccttagcaatattgtgcgggaagaggacgaacaggagacaaactctaaattcgttgtgtcctgcagcggaggcatcaccgatagactgaagcaggactgggggctcaatgacgtctggaactctatcgtgtatccgcgctttgagcggctgaataaactgacacagaccgaagcgttcggaagatgggagaacaaggaaggcaaacaagtgtttcagacctcccttcctctggagctccagcgcgggttcagcaagaagcggattgatcacagacaccatgccatggacgctctggttatcgcctgcgcttctcgcaatattatcaactacctcaacaatgaaagcgccaaatcccaggagcaacgggaggatctgagaaagaaactttgtgacaagaaccggattatccgcaaaccctgggaaacatttacgcaggatgccagaaccgctctggaggacgtcgtggtgagcttcaagaattatgtccgggtgatcaacaaggcgacaaattactatgaaaaatacgatgagtctggaaagaaaggcatggccgaacagaaggggcaagacatgtgggctattcgcaaacctatgcacaaggagaccgtttttggccaggtgaacctcagacggaaagtcacagtgaagctgaaggatgccctggagaatatccccgccatttgcgacaaagctcttagagattacgttaacgacctgatcgccaagaaattcaataccaagcagatgctcgcgcattttaaatccattaactatcgcctgaatatgaaaagcgtgaacaaggtcggaatctgggtgttctccgacgaaaaagagcctatggttgctacgcggaaggccatcgatatttctttcgacgccaaaagaatcgatacaattaccgacaccggcatccagcaaattctctgtaagtacctgaaaagcaaggggaatgatcccaacgtggcttttacaccggaaggaatcgccgagatgaataagcacattatcgactataacaacggcaaacagcatcagcctatccttaaggtccgcgtgtccgagcccaaaggggcgaagtaccaggtgggagaaaccggcaataaaacaaagaagttcgtcgaggctcaaaaagggacgaacctgtattttgccatttacgaagataaggacggcaatcggtcttataacaccatccccctcaatgaggttgccgaaagactgaaacagggactgagccctgtgccggagaagaacgagaaaggcatttcccttaagttctacctgtctcccaatgatctcgtgtacgtccctacagaagaggaaaaactgagcaacgagtgcaagctctccaaggaacgcatctataaaatggtgagctctacctccaatgagtgtcactttattccctacacaaccgctaagcctatctatgacaaattcgagtacgaagccaagaacaaaatggggcgggctctgacgggagagatgatcaaggccgtttgctggaaacttgaagtggatagactgggcaatattctgaagatcattaagtga

SEQ ID NO: 4557 - RNA, 4452 nt, synthetic construct
  misc_feature 1..4452: note = Cas9 variant
  source 1..4452: mol_type = other RNA
atgaagaccatcctgggcctcgacctggggacaaacagcattggatgggccaaaatctccattgatgacaatggcaactaccttagagatatccagatggggtctcggattatccccatgagccaagacgtgctgggaaatttcgattccggcgtcacggagtctcagaccgctgttcgcacagggtttagaggactccggcgcatcagagaacggagcctgcttcgcagagagcggctgcaccgcgtgctccatgtgatgggcttcctgcctccgcactatgactccgccattggctggaacaaggaagaacccaccacatacgggaaatttctgaatcatggagaacctaagctcgcgtgggagagacagggcgatgggtctatgcggttcctgtttatggacagcttccacaaaatgatggaggattttgctccccatcagcctgcccttgtcgccgacggacgcaagatccccctggattggaccctctattacctgagaaagaaagctcttacacaacctattaagaaagaggagctggcctggatcctcctgaacttcaatcagaagcggggctattaccagctgcgcggggaagaggaggaagagaacccgaccaaaagagaagagtatcacgaactcaaggtggtttccgtggaggctgccgaggaaggaaagggcggcaatacgtggtacaacgtcaaactggagaatgggtggatttaccggagaagctctaagatcccccttgacgattgggtgggaaaaacccgcccttttattgttacaaccgaatatgaggcggacggcatcacactgaagaaaaacaaggaaggggaggtgaaacggtccttcagagcccccggagaggacgattggggcctccgcaagaagcggaccgaaagccagctggaggcttctgggaaaacggtcggagcctttatctacgaccaccttctggctgaacctgccgataagattagaggcaatttcatccgcacaattgagcggaaatattacaagcaagaactcgcggacatcctgagagagcagtccaaatatcatgaggaactgcagagcaagaagattctcgccgattgcgctgaggaactgtaccgctctaaccagccccaccgggactcccttctgaaaaaggatatggtgtatctcctgcttaccgacatcatcttttaccaaagaccgctgaaaagcaagaaatccctcattgccgattgtccttacgagtattacgagtatgtggacaaggaaacaggcgagatcaagcgccaggggattaaatgcgtcgctaagtctaatccctactatcaggaatttcggctgtggcaattcgttctgaacctcagactgtacgatcggaccgaggacaaagaagtgaccgccgagtatcttcctagcaaggaggactacgcccgcctgtttgtgtacctcaacgatagaaaagaaatcaatcaggagacactgctgaaggacttctttaagctcaaaaaggtcaaacagcggtccgaaaaggagttccccgtgagatggaactatattgaagataaagagaagaaatacccctgtaatgagacgcgccatgaactcctgatggctctggaccgggcgggaatcgagagaagctggctcgatgacaccgcccgccagtgcagactgtggcaccttctgtattctatcgaagttaaggatgaggctgaacgggccctccgcaagctgaaagacgatgacgagtttgtgtccgccttcctgaaggtcaaaccttttaagaaagattacggcgcttatagcgagaaggccgtgaagaaacttctcgcggttatgagaatggggtctcactggtgtgaagacgatatttgcaaggagacaaaagaacggatcgagcatattctgcaaggagacgtggaggaaaagatcaaagagcgcatgaaccacaccgcttacagcctgggcgaactctccgacttccaggccctgccggagtggcttgcctgttatgtcgtgtacgggagacattctgaagctacagatattaagcactggaagacccccgagagcctgatggcctacatcaatggctttaaacagcattccctccggaaccctattgtcgagcagtgcatcctggaaacgctgcgcacagtgcacgacatctggaaggaggctggacacattgatgaaatccatgttgagcttggcagaagcatgaaatctacctccgaccaacgggcccgcatgaccgaaaatattctcagaaacgagaatacaaacctgcggatcaagagcctgctcatggagctgaaaaatgatgcggacattaaggatgtgagaccctattctcctatgcagcaggaaatccttcgcatctacgaggaaggggccctgcaggagctcaccaaggaagacaacgattatgaggagattttcaaaatctccaagatgccccaaccgagcgctaaagaactgctgaagtacaaactttggctcgagcagaagtatcggtccccttacacaggaaaacccatttctctgagcaagctgtttacgtccgcctatcagatcgaacacattatccctcagtctagatacttcgacgatagctttaataacaaggtcatctgtgagtccgaggtgaatgctctcaaaggcaacatgctggggtacgagttcattaagaaccatggaggcgaaatcgttcactgcacccttctgggggacgtgaaagtccaaaatgaaagcgagtataaggccttcgtgacagaacactacgcgaacaataaatataagaaggagaaactcctgatggaggatattccccaggactttctgaaccgccatcttaatgactctcggtacatctccaaggtggttaaaaccctgctcagcaacattgtcagaacagaagatgagatggaaaccacgtctaagttcgtggtgtcctgtaccggcggaatcacagaccgcctgaaaaaggattggggcctcaatgacgtctggaacagcatcgtgtattctcggtttgagagactgaatgaacttaccaagagcgatgccttcgggcgctgggagaacaaagagggaaagcgggtttttcagacatccgtgcctctggaactccaaagaggcttcaataaaaagcggattgaccaccgccatcacgctatggatgccctggtcatcgcttgcgccagcagaaacattatcaattacctgaacaatgagtctgccaactcccccaaaaagcgggaagaccttcgccagcagctgtgcgataagaacagaattatccggaaaccgtgggagagctttacccaggacgctagagcggccctcgaagatgtggttgtgtccttcaagaattatgtccgcgtgattaacaaagctacgaattactacgagcggtatgacgccgacgggaagaaaacaatcaccaagcaaaagtctagagagatgtgggccgttcgcaaacctatgcataaggaaacagtgtttggacacgtcaacctgcggagaaaagctatcgtgaagctcaaagatgccctggagaatattcccagcatctgtaacaaggaacttcgcgactacattaatggcctggtggagcggaacttcaataccaaacagctccacgcgcattttagatccaccgattatcgctggaacaagcagaatgtcgacaaggttgaggtgtggagattctctgatgaaaaagagcccctggtggctacacggaagcctctggacacgagctttgatgccaaacgcatcgacaccattacagataccgggatccagaagatccttctgaactacctcgaagccaaaggcggagacccgctgattgctttcacacccgagggcatcgccgaaatgaatcaaaacattgcgctctataatgatgggaagatgcaccagcctatcctgaaggtcagaatttccgagcccaaaggagctaagtaccagatcggccagaccgggaacaaagccgacaagttcgtggaggcccaaaaaggaacgaacctttattttgctatctacgaagatgaggaccggaatcgcacatacaacaccattcctctgaatgaagttgccgagagactgaagcagggccttccccctgtgcccgaaaagaacgagaaagaggtcccgctgaagttctatctttctcctaatgacctggtgtacgttcccaccgaagaggaaatcctcatgaaagagtgcaagctgaacaaaaatcggatttataagatggtgagctccacagggaaccagtgtttcttcatcccttttagagtcgctgtgagcattgttaataagatggaatactctcccctcaacaaaatggagaaggccatctccagcgagatgattaaagcggtgtgctggaagctggaagtcgatcgccttggcaatatcatccgggtggtgaaatga

SEQ ID NO: 4558 - RNA, 4452 nt, synthetic construct
  misc_feature 1..4452: note = Cas9 variant
  source 1..4452: mol_type = other RNA
atgaagaccatcctgggcctcgacctggggacaaacagcattggatgggccaaagtgtcccttgatgacaatggcaactacctgcacgatatcaagctcgggtgcagaattatccccatgtctcaggacgtcctggataatttcggaaaaggcgttacggtgagccaaacctccgtgcggacagggtttcgcggagtcagacggattcgcgagagatctcttcagcggcgcgaaagactgcatcgggtgctccaccgcctgggcttcctgcctcagcattatgacgctgccatcggctgggatagcgactgtgcgaagacctacgggaaatttctcgataacggagagccgaagctggcttgggaaagacaggaggacggctccatgcggttcctttttatgaatagcttctatgaaatgatcgccgattttacaagccaccaacccgccctggttgctgacgggaagaaaattcctctcgattggaccctgtactatcttcgcaagaaagccctgacacaggctatcagaaaggaggagctcgcctggattctgctgtccttcaaccagaaacggggatactatcagctccgcggcgaagaggaagacgagaatcccaccaagagagaggaattttgcgagctgaaggtggtcgcggtggaagccgctgagaaagggaagggagacgatatctggtacaacgttcatcttgaaaatggctgtatttaccggagaagctctaaaatctccctggacgattgggtgggcaagacgaaacaattcattatcaccacagagtatgagaaggacggggtcacccctaaaaaggataaggacggaaaagaaaagcgcagctaccgggcccccaaagaggatgactggggcctcagaaagaaacgcacagaaaccgatctggaggcttctgggaagacggtgggagcctttatctatgaacaccttctggcggagcctttcgacaagattcggggcaactttatccacacaattgagagaaaatactatcgcgccgaactcgaggctatcctgaccgaacagcggaagtaccatgaggaactgagatccgagcagatgctcgccgtgtgcgctgaggaactgtatcgcagcaatcttccgcaccagcaatctctgctcaaaaaggatatggtctacctgcttctgtccgacctcattttctaccagcggcccctgaaaagcaagaagtccctgatcgccgactgtccttatgagtactatagatacgttgataaagaaacaggggagatcaagaaacagggaattaagtgcatcgccaaatctaacccctattaccaagagttccgcctctggcagtttgtgctgaatcttcggctgttcgacagaatgaccgataaggaagtgaccgctgactatctccctacaaaggaggattacgtccggctgtttgactacctgaacaatcgcaaagaaattaaccaggagacgcttctcaaggatttctttagactgaaaaaggtgaaactgggccgggaaaaggagttcgagatcagatggaactatattgaagacaaagagaagaagtacccctgtaatgaaacccgctatgagctcctggttgcgcttgatcgggccggcatcgacagaagctggatcgatgaagacgggcgccagtacagactgtggcatctcctgtattccattgaggtgaaagctgaggccgaaagcgccctgcggaaacttaactctgatgacgcttttgtctccagcttcctcaaagtgaagccgtttaaaaaggactacggagcctattctgagaaggcggttaaaaagctgctggctgtgatgcgcatgggcagcatgtggtccgaagccaatatctgcgaggaaacacaaaaccggattagatctatcattcgcggggatatcgaggagaaaattaaggaaagaatgggacacaccgcccggagcttcaatcagatcgacgattttcaggctctccctgagtggctggcctgttacgtcgtgtacggccgccactccgaagtcacagacatccagcattgggagacccccgagcaacttcagagctatattaacgggttcaaacagcactctctgagaaatcctatcgtggaacagtgcattctcgagacgctgcggacagttcatgatatctggaaggaagctggccacattgacgagatccatgtggaactgggacgcgatatgaagagaaccgccgaccaacgggcgagaatgaccaaaaacatccttaagaatgagaacacaaatctccgcattaaatccctgctgatggagctcaagaaagataccgacatcaaggaagtccggccctacagccccatgcagcaggagattctgagaatctatgaagagggcgcccttctgcagctcaagcgcgatgacgaggcttttgccgatatttctaaaatctcccaaatggctcagcctacagccacggaactgcggagatacaagctgtggcttgaccagaaatatcgcagcccgtacaccgggaagttcatctccctctctaaactgttcacaagcgcgtatcaaattgagcacgtgatcccccagtcccggtactttgacgattctttcagcaacaaggttatttgtgaagccgaggtgaatagactgaaatccaacatgctcggatacgaatttatcaaggctcacggcggggagattgtccattgcaccatgctgggagacgtgaagatccttagcgaatctgagtataaagccttcgtgaatgagcactacgttaaccatcgcgctaagaaagaaaagctgctcatggaggatatccctcaggaatttctgaaccggcagatgaatgactccagatatattagcaaagtcgtgaaggccctgctttctaacatcgtgcggacagaggatgagatggacgtcacctccaagttcgtggttccctgcagcggcgggattacggatcgcctgaaaaaggactggggcctcaatgatgtgtggaactctatcgtctaccctagatttgaacggctgaatcgcatgaccggaacagaggccttcggccactgggaaaacaaagaggggaagagagtgtttcaaaccagcgttcccattgaactccagctgggattctccaaaaagcggatcgaccacagacatcacgctatggatgcgcttgtgattgcctgtgctagccgcaatatcatcaactatctgaataacgagtctgccaattcccagaagaaacgggaggacctcagacgcctgctgtgcgacaagaaccggattatcagaaaaccgtgggaatcttttacacaggatgcccgcgtcgcccttcaagacattgtggtttccttcaagaattacgtgcggatcattaacaaagctaccaattattacgagagatacgatgaacagggcaagaagacgacagcggagcagaaatctagcgaaatgtgggctatccgcaagcctatgcataaagagaccgtctttgggcacgtgaacctgaagagaaaaacaaccgtgaagctcaagaacgccatcgagaatattcccaacatctgtaataaagaactgaaggcctatattaacgagctcgtcgaaaaacatttcaataccaagcagatgctggctcacttcaaatccatcaactaccggtggaatcgccaaaacgttgagaaggtggaagtgtggcagtattctgacgagaaagagagaatggccgcgacacggaagcctcttgatacgagctttgacaagaaacgcattgaaaccatcacagataccggaatccagaagattctgctcaattacctggaggaaaaaggcggggaccccaacatcgctttcacacctgagggcattgccgagatgaataagaacatctccctgtttaatgatggaaaacttcaccaacccattctgaaggtcagagtggccaagaccatgggcgctaaatatcaggttgggcagacgggaaacaaggccgctaaatacgtgggcgcccaggaagggacaaatctctatttcgcgatctacgagaacgaagagggagaacggtcttacaacgccgtcccgctgaatgaggtggctgagagactcaagcaaggcatgagccctgttcccgaaaagaacgagaaggacgtgcccctgaagttttatctttcccctaatgatctggtctacgtgccgaccgaagaggacaaactgagcaacgaatgcaagctcgataatgagcgcatttataaaatggtttctgccaccgggaagaaatgtcatttcctgccctactccgtggctaacatcatctataataaggtcgagtttgaaagcatgaacaagatgggcaaagccctttctggagagatgattaaggccgtgtgctggaaactggaagtggaccggctcggcacaatcctgagagtcattaagtga

SEQ ID NO: 4559 - RNA, 4452 nt, synthetic construct
  misc_feature 1..4452: note = Cas9 variant
  source 1..4452: mol_type = other RNA
atgaagaccgagctggacctcaacaaagatagactgtacaagcacgtgcttggcctggacctcggggtcacaagcatcggattcgcccatgttgtggaatccgagaatcggaacgaatctgagattaaacagatcggcgtgcgcgtcattcaactggataattttgacaaggtggataaaagcgggaagacgtccgaatctaagaaccccgctgttgacttcgccgcgggaaaaggccttacccctaatgggagcagaacaaagaaacggggagctcgcagaaacctggatcggtatcaggaccgcagagataatctcctggaggtgctgaccaagtccggctttatcaactctgagacaaaacggaccgaagacggcaagcacacaacccatcagacgtgggagattcgcgccaaggccgtcagcgaaaaagtggagaaggaggaatttgctagaatcctcctggccatcaataaaaagcgggggtacaaatccagccgcaaggctaaaaacgaggatgaaggacaggccgttgacggcatggcggtggccaagagactttatgaggaaaatctgaccccggggcaatacgcttatgaggtcctctctggaggcaagaaatccattcccgatttttaccggagcgacctgcaggccgagttcgacaagatctggaactttcagaaacagttctatcctaatattcttacagatgaattttacgaggaactgaaggggaaaggacaacgcgctacctctgccgcgttctggaagatccaccagtttaacacagccgacattaaggatctcgaggacgaactgaaaaatgagagaaccatcaagctgtccaaacgggatcagaagaaactccaggcttacaagtggagaagcgaggccgtggtgaagcaactgggcaaagaagaggtcgcttatgttcttacggaaattaacaacaatctgaacaattcttccggctacctcggggccatcagcgaccgctccaaggagctgtatttcaacaaacagacagtgggacagtttctttacaagcaactgaaagaaaatccccatacccggctcaagaaccaggtgttctatagacaggattacctggacgagttcgagacaatctgggaaatgcaggcccaatttcaccctgagctgacccaggaactcaaggaggagattcgcgatatcattatcttctatcagcggaaactgaagtctcagaaaggccttattagcttttgcgaactggagtccaaggaagtcgtgatcaatgacaccaaaaagatcattgggctcagagttgctcccaaaagctctcctctgttccaagagtttaagatctggcagaaccttaataacgtgctggtccgcaagaaaggatcccggaagagaatggtgaaagcgcagaatcagcacagcctcttcgaggaaccgaaggagattttctctctggatctggccagcaaagaaaaactcttcgaggaactgaaccttaagggcaatctgtccgctaaaaactgtctcgacatcctggggcttaattctaacgagtgggaactgaactacacacaactcgagggaaatcgcacgaacaagagcctgtacgaggcctttctgaaaattctcgacatcgaaggctatgatgttaaggacctgcttaaagtgaagtccagcaaggatgaggtcgaactggacgatctcaaagtgcccgcctctgagatcaagaatatggtccgggaaattttctccaccaacaaaatcgacacagagattctggattttgacgctgagatcgatggcaaggccttcgaaaaacagagctcttaccagctgtggcatcttctctattcctacgagggggacgatagccagtccggaaatgaaaagctgtatgagctgctcgcgaagaaatttggcttcaagagagagcacgctcaaattctggccaacgtgtctcttgttgacgattacgggaatctgagctccaaagccatgcgcaagatctatcctcatattcgggaaaacaattactctaccgcttgcgagctcgtgggatacagacacagcaaacactccctgacaaaggacgaactgaaagaccgggtccttgaggatcgcctcgaactgctgaagaagaacagcctcagacagcccgtggttgagaaaatcctgaatcagatgatcaacgccgtgaatgctcttattgagaagaactctgaacgggacgagaatggcaacatcaccaaatatttcaagtttgatgaaattagaatcgagctggcccgcgaactcaaaaagaacgcggccgagcgggctgagatgacgacaaatattaacgccgctaagctggtccatgaaaagatcttcaagatcctgcaaaatgagtttgggattaaaaaccctaccagaaatgacatcattcgctacagactttatgaggaactcaagggcaacggatacaaagatctgtattccaatacctacatcccccgggaaattctgttcagcaaccagatcgacatcgatcacattctcccgcagtctcgcctgtttgacgattccttcagcaataaggtggtggtttttagaaaggacaaccttaaaaagggcaatcagacagccatcgattatattgggtctgaggtcggagaggaaggcctgaaaaacttcatcgagcgggtggaaagcctctacgagctggggaagaaaaataaggaggaaggaatttccaaggcgaaataccaaaagctgcttaaaagcgcctctgagatcggcgacgggtttatcgaacgcgatctgagagagtcccagtatattgctaagaaagccaaggaactcctgttcaaggtgacccggagcgtcgtgtccacatctggcagcatcacggaccgcctcagagaggactggggactgattaacgttatgaaagagcttaatctgcctaagtacaaatccctcggcctgaccgaaatccaggagcggcgcaacgggcatcaggtggaagtcattaaggattggacaaaaagaaacgaccaccggcatcacgctatggatgccctggccgtggcttttaccaagcacaatcatatccaatatcttaactacctgaatgcgcgcaaaaacgagtctcacaagctccatggaaatattatcgccatcgaaacactggagaccgaggttaagattgacgatctcggcaacaaaaagagagtgttcaaagaacccatccctaattttcggcaggtcgctaaggagcacctggaaaacgtgcttattagccacaaagccaagaataaggttgtgacgaaaaacaagaataaaatctccgggaaggagaaactgcagattaccctcacacccagaggacagctgcataaggaaaccgtctatggcaagtaccgcttctatcaatctaaagacgagaaggtgagcgccaaattcgatctggagacaatcgaaaaggtggctaacccctcctacaaagccgcgcttctgcagcggctcaatgagaacgaaaatgaccctaagaaggcttttagcgggaaaaacgccctgtctaagaatccgatctacatttccatggagaacgatatcaaagtccccgacaccgttaagctcgtgtggctggaggaagattatagcattagaaaagacgtgacgcctgagaacttcaaggacgaaaaatctatcgagaagattcttgatgaaggcgtcaagcgcatcctgaaaaatcggctgaaggagtttggaggcgacgccaaagaggctttctccgatctcgacaagaaccccatctggctgaatgaagagaaagggacaagcattaagagagtgcgcatctctggagttaagaacgccgaacctcttcactacaaaaaggatcattttggcaatgacattctggatgggaacggaaataaaatccccgcggacttcgtgtccaccggcaacaatcaccatgtcgctatttataaggagccggaatttgataaaaaggggcagcctgtgctcgacgagctgggcaaccaaaagtacaatctccaggagaaagttgtgagcttctttgaagccgtcgagcgggtgaaccagggactgcccatcattgataagacatataatcagcaccttggctggcaattctttttcaccatgaaacagaacgaaatgttcgtttttcctaatgagaagaccagattcaaccccatcgaaatcgacctgctggatcctaacaataaaaagctcatttccctgaacctttttcgggtgcagaagatcgccaataaaaactacatgttccgccaccatctggagacaaatgtcgacgacaagaaagagatgaagaacattgcttttatccacattcagagctgtaatctcctgaaagaaatcatcaaggtgagactcaaccatctgggggatattgtgtctgtcggagagtattga

SEQ ID NO: 4560 - RNA, 4452 nt, synthetic construct
  misc_feature 1..4452: note = Cas9 variant
  source 1..4452: mol_type = other RNA
atgaagaccatcctgggcctcgacctggggacaaacagcattggatgggccaaagtgtccgtcgatgaccacggcaattaccttcatgatatcaagctggggtctagaattatccccatgagccaggacattctcggaaacttcgataaaggcgttacggagtcccaaaccgctatccggacagggtttcgctctgtgagacggatccgcgaaagaagcctgcttcggcgcgagagactgcaccgggtgctccatgtcatgggattcctgcctccgcactatgactccgccattggctggaatcgcgaagaggcgtctacctacggcaagtttctgaaccatggggaacccaaactcgcttgggagagactggaggatggaagcatgcggttcctttttatggactccttccacgaaatgatggccaattttgcccgccaccagcctgctctggtggccgatggcagaaagatccccctcgactggacactgtattaccttcggaagaaagctctgagccaggccgttgggaaggaggaactcgcgtggattctgctgaacttcaatcagaaacgcggatattgccaactcagaggcgaggaggaagaggaaacccctacaaagcgggaggaatactatgagctgaaagtggtctctgtggaggccgctgaagaggggaagggaggcaacacctggtacagagttcagcttgaaaatggctggatctaccgccggccctccaagattgccctggatgactgggtggggaaaacgaagcagtttatcgtcaccacagagtatgaaaaagatggaaccacactcaagaaagacaaggacggcgaggtgaaacgcagcttcagagctcctggggagaacgattggggactgcggaagaagagaaccgaatctcagcttgaggcctccggcaaaacggtgggggcgtttatttacgaccatctgctcgccgaaccggctgataagatccgcggaaatttcatccggacaattgagagaaaatattacaagcaagaactggaggccatcctgcgcgagcagaccaaacaccatgaggaactccggagcaaggaaatgctggctaagtgtgccgaggagctttatcagtctaaccagccccacagaaaatccctgctcaataaggacatgacatacctgcttctgaccgatctcattttctatcaacgccctctgaaaagcaagaaatccctgatcgccgaatgcccctacgagtactataagtacaaggacaaagaaaagggcaaaaagaaacggcagggcattaagtgtgtcgctaagtctaacccttattaccaggagttcagactctggcaattcatcgttaatctgcggctttttgatcgcaccgacgataaagaagtgacagcggagtatctgagaagccgggaggactacgccagactcttcgcttatctgaacgatcgcaaggaaatcaaccaggagacgctgcttaaagactttttcgggctcaagaaagtgaagattggagccgaaaaagagtttgccatccggtggaattacattgaagacaaggagaagaaatacccctgcaacgagaccagacacgaactgctgctcgctctggatcgcgccggcatggacagatcctggcttgatgacagcgagctgcagtatcggctctggcatctgctgtactctgtcgaagcgcgcgatgaggctgaaggggcccttagaaagctccgggacgatgacgagttcgtgggagcctttctgaaagttaagccgttcaaaaaggattatggcgcttactccgagaaggccgtgaaaaagctgctcgctgtcatgcgcatggggagctggtggcacgaagaggacatctgtaaacagacaagagatcggattgaacgcatcgtgcaaggcgacatcgaggagaagattagagaacggatgggacatgccgcgtattcttttagccgcctggccgatttccagggccttcctgagtggctggcttgctacgttgtgtatgggagacactccgaagccacccatatcctccggtgggactctcccgacaaactgctgagctacattaagggatttagacagcactcccttcgcaatcctatcgtcgagcagtgtattctcgaaacactgcggaccgtgcacgatatctggaaggaggctggccatattgacgagatccacgtcgaactggggagaagcatgaaatctacggccgagcaacgcgcgcatatgacaaagaacatcctccggaatgaaaacaccaatctgagaattaaatgccttctgatggagctcaagaacgatgccgacgtgaaagatgttcgcccctactcccccatgcagcaggaaatcctgcggatttatgaggagggagctctgcagcaacttaccaaggacgatgccgaatacgctgagatcagcaagatttctaaaatggcccagccttccgccaaggaactcctgagatataaactgtggctcgagcagaagtaccgcagcccgtatacaggcaaacccatctccctgtctaaacttttcaccagcgcttaccagatcgaacacgtgattcctcaatcccggtattttgacgattctttcaataacaaggtcatctgtgagagcgaggtgaatacactgaagtccaacatgctcgggtacgaatttattaagaatcactgcggcgagatcgttcattgtacgatgctgggagacgtgaaagtctttagcgaatctgagtacaaggcgttcgtgaccgagcactattccaacaataaatacaagaaagaaaagctgcttctggaggatattccccaggaatttctcaacagacagatgaacgacagccggtatatctctaaggtggttaaaggcctgctctccaatgtcgtgcgcacagaggatgaactggaggccaccagcaagttcgtggtctcttgcacagggggaatcaccgacagacttaaaaaggactggggcctgaacgatgtgtggaatagcattgtttactcccggtttgagcgcctcaacgggctgacgaaaagcgaacatttcggacactgggagaataaggaaggcaagagagtgtttcaaacctctgtccctatggagctgcagcgggggttcaacaaaaagagaatcgaccatcgccaccacgctatggatgcccttgtgattgcctgcgcttcccggaatatcattaactatctgaataacgaatttgccaaaagccccaagcagagagaggacctccgccagctgctctgtgataaaaatcggatcatcagaaagccgtgggagacattcacccaagacgcgcgcgctgccctggaagatgttgtggtctcctttaagaactacgtgcgggttattaataaaacaaccaactattacgagagatacgacgccgatggcaagaaaacgatggtgcctcagaagggaaatgaaatgtgggctgtccgcaaacccatgcatgagggcacaatgtatgggagagtgaaccttcggcgcaaggccgtggtcaagctgaaagaagcgctcgagaacatctctagcatttgcaataaggagctgagagactacatcaacgttctggtggaaaaacagttcaataccaagcagcttctggctcactttaaatccatggattatcggtggaacaagcaacatattgacaaagtggaggtctggcgcttctctgacgaaaaggtgcagatggttgccgccagaaagcctctcgataccagcttcgacaaagagtgtatcgcttccattacagataccggaatccagaagatcctgctcaattacctggagtctaaaggcggggaccccgccattgcttttacaagcgaaggaatcgccgagatgaaccagaatattgcggtgtataacgatggcaagaaacaccaacctgtcatcaaggtgcggaagtccacgaaacttgggaagaaattcgccgttggccagattggatgcaagagcaaacagtttgtggtcgctgaagccggcaccaatctgtacttcgctatctatgaggacgaagaggggaagagatcttacgatacaatccccctgaacgaggtgaccgaacgcctcaagcaaggactgtccccggttcctgagaaaaatgaaaaggaggtgccccttaaattttacctgagccccaacgacctcgtctatgtgcctacagaagatgagatgcagatgaaggagtgtaaactgaataaggaacggatttacaagatggtgtcttccaccggcaacgagtgccatttcctcccgtatagcgtcgcctctgttatctacaataaagtggaatttgagtccatgaacaagatggggagagccctgacgggagaaatgattaaagctgtgtgttggaaacttgacgtcgatcgcctgggcaacatcctgcgggtgattaagtga

SEQ ID NO: 4561 - RNA, 4452 nt, synthetic construct
  misc_feature 1..4452: note = Cas9 variant
  source 1..4452: mol_type = other RNA
atgaagaccatcctgggcctcgacctggggacaaacagcattggatgggccaaaatctccattgatgacaatggcaactaccttagagatatccagctggggtctcggattatccccatgagccaagacgtgctcggaaatttcgataacggcgtcacggagtcccagaccgctgttcgcacagggtttagaggactgcggcgcatcagagaacggtctcttctgcgcagagagcggctccaccgcgtgctgcatgtgatgggcttcctgcctccgcactatgacagcgccattggctggaataaggaagaacccaccacatacgggaaatttctcaaccatggagaacctaagctggcgtgggagagacagggcgatgggtccatgcggttcctttttatggactctttccacaaaatgatggaggattttgctccccatcagcctgccctggtcgccgacggacgcaagatccccctcgattggaccctgtattaccttagaaagaaagctctgacacaacctattaagaaagaggagctcgcctggatcctgctgaatttcaaccagaagcggggctattaccagctccgcggggaagaggaggaagagaatccgaccaaaagagaagagtatcacgaactgaaggtggttggagtggaggctgccgaggaaggcaagggcgggaacacgtggtacaatgtcaaacttgagaacggatggatttaccggagaagctccaagatccccctggacgattgggtgggcaaaacccgcccttttattgttacaaccgaatatgaggcggacgggatcacactcaagaaaaataaggaaggagaggtgaaacggagcttcagagcccccggcgaggacgattgggggctgtggaagaagcgcaccgaatctcagcttgaggcttccggaaaaacggtcggcgcctttatctacgaccaccttctcgctgaacctgccgataagattcggggcaacttcatcagaacaattgagcgcaaatattacaagcaagaactggcggacatcctgcgggagcagagcaaatatcatgaggaactccagtctaagaagattctggccgattgcgctgaggaactttacagatccaatcagccccaccgcgacagcctgctcaaaaaggatatggtgtatctgcttctgaccgacctcatcttttaccaacggccgctgaaatctaagaaatccctgatcgccgattgtccttacgagtattacgagtatgtggacaaggaaacaggggagattaagagacagggaatcaaatgcattgctaagagcaacccctactatcaggagttccgcctctggcaattcgtcctgaaccttcggctgtacgatagaaccgaagacaaagaagttaccgccgagtatctcccttccaaggaggactacgcccggctgtttgtgtacctgaatgatcgcaaagaaatcaaccaggagacacttctcaaggacttctttaagctgaaaaaggtgaaacagagatctgaaaaggatttccccgtccggtggaattatattgaggacaaagaaaagaaatacccctgtaacgagacgagacatgagctgctcatggctctggatcgcgcgggcatcgaacggagctggcttgacgataccgccagacagtatcgcctgtggcacctcctgtactccatcgaggtgaaggacgaagctgagagagccctgcggaagctgaaagatgacgatgaatttgttagcgccttcctcaaggtgaaaccttttaagaaagactatggggcttactctgagaaggccgtcaagaaactgctggcggtgatgcgcatgggatcccactggtgcgaggatgacatttgtaaggaaacaaaagagagaatcgaacatattctccaaggcgacgttggggagaagatcaaagagcggatgaatcacaccgcttatagcctgggcgaactttctgatttccaggccctgccggagtggctcgcctgctacgtggtctacggacgccatagcgaagctacagacattaagcactggaagacccccgagtccctgatggcctatatcaacggctttaaacagcattctctgagaaatcctattgtggaacagtgtatccttgagacgctccggacagtccacgatatctggaaggaggctgggcacattgacgaaatccatgtggagctgggacgcagcatgaaatccaccagcgatcaaagagcccggatgaccgaaaacattctgcgcaatgagaacacaaatctcagaatcaagtctctgcttatggaactgaaaaacgacgcggatattaaggacgttcggccctactcccctatgcagcaggagatcctcagaatctatgaggaaggcgccctgcaggagctgaccaaggaagataatgactacgaggaaattttcaaaatcagcaagatgccccaaccgtctgctaaagagcttctcaagtataaactgtggctggagcagaagtaccgctccccttatacagggaaacccattagcctctccaagctgtttacgtctgcctaccagatcgaacacattatccctcagagccggtacttcgatgactcctttaacaataaggtgatctgcgagtctgaagtcaacgctcttaaaggaaacatgctgggctatgagttcattaagaatcatgggggcgagatcgtgcactgtaccctcctgggagatgttaaagtgcaaaacgaaagcgagtacaaggccttcgtcacagaacactatgcgaataacaaatacaagaaggagaaactgcttatggaagacattccccaggactttctgaatagacatctcaacgattcccgctatatcagcaaggtggtgaaaaccctgctctctaatattgttcggacagaggacgagatggaaaccacgtccaagttcgtcgtgagctgcaccggcgggatcacagatagactgaaaaaggactggggacttaacgatgtgtggaactctatcgtctactcccgctttgagcggctgaatgaactcaccaagagcgacgccttcggcagatgggagaataaagaagggaagcgcgtgtttcagacatctgttcctctggagctgcaacggggattcaacaaaaagagaattgatcaccggcatcacgctatggacgcccttgtgatcgcttgtgccagccgcaatattatcaactatctgaataacgagtccgccaacagccccaaaaagagagaagatctccggcagcagctgtgcgacaagaatcgcattatcagaaaaccgtgggagtcttttacccaggatgctcgggcggccctcgaagacgtcgtggtttccttcaagaactacgtgagagtcattaataaagctacgaactactatgagcgctacgacgccgatggcaagaaaacaatcaccaagcaaaagagccgggaaatgtgggccgtgagaaaacctatgcataaggagacagtttttgggcacgtgaatctgcgccggaaagctatcgtcaaacttaaggacgccctggagaacattccctccatctgcaataaggaactcagagattatattaacggcctggtggagcgcaatttcaacaccaaacagctgcacgcgcattttcggtctaccgactacagatggaataagcagaacgtggataaggtcgaagtttggcgcttcagcgacgagaaagagccccttgtggctacaagaaagcctctggatacgtcctttgacgccaaacggatcgataccattacagacaccggaatccagaagatcctcctgaattatctcgaagccaaaggcggggatccgctgattgctttcacacccgagggaatcgccgaaatgaaccaaaatattgcgctttacaacgacggcaagatgcaccagcctatcctgaaggtgcgcatttctgagcccaaaggggctaagtatcagatcggacagaccggcaacaaagccgataagttcgtcgaagcccaaaaagggacgaatctgtactttgctatctacgaggacgaggacagaaaccggacatataataccattcctctcaacgaagtggccgagcgcctgaagcagggccttccccctgttcccgaaaagaatgagaaagaagtgccgctgaagttctacctcagccctaacgatctggtctatgtgcccaccgaggaggaaatcctcatgaaagagtgtaagctgaataaaaacagaatttacaagatggtttcctctacaggaaatcagtgctttttcatcccttttcgggtggctgtcagcattgtgaacaagatggaatatagcccccttaataaaatggagaaggccatctcctctgaaatgattaaagcggtttgttggaagctggaggtggacagactgggcaacatcatccgcgtcgtgaaatga

SEQ ID NO: 4562 - RNA, 4458 nt, synthetic construct
  misc_feature 1..4458: note = Cas9 variant
  source 1..4458: mol_type = other RNA
atgaagaacatcctgggcctcgacctggggaccaatagcattggatgggccaaaatctccattgatgacaacggcaagtacatcaaagattctattaaacttgggagcagaatcatccccatgtcccaggacgtgctgtctaatttcagcaaaggagtcacactctcccaaacgtctgagcggaccagctttcgcggcgctagacggctgcgcgaaagaacacttctgcggcgcgagagactccaccggattctgcatctgctcgggttcctgcctaagcactatgaaaaggccatcggatgggatcgcaacgacaataaaacctacggcaagtttattaaccatgcggagccgaaacttgcttggtgcaaggataataacggcaaaatgagattcctgtttatggactccttccacgatatgctcagcgaattttctgagaagcatcccgagctgcttgccaatgggaagaaaatccctctggactggacaatttattacctccggaagaaagccctgtataaggctatcaccaaagaagaactggcctggattctcctgaacttcaatcagaagcgcggatactatcagcttagaggcgaagaggatcgggactccgaggctaacaaaaaggaatacctggagctcaaggttatcggggtggaagccacaggagagaaaaagggcaatgatatctggtacaacattcacctggaaaatgggtggatctatcgcagaagctctaaaaacccccttaacgactggctgggaaaggtgaaatcctttattgtcaccacggacctcgatgcggacggcaatcctaagaaggataaagacggcaacatcaagcggagcttcagagccccctctgagggggattggaccctgattaaaaagcgcacagagtccctgctcgaaaatagcggacagaccgtgggccaatttatctacaaccacatcctggaggaaccttccgctaaaattcgggggaatttcatcagaacaattgagcgcaagtattacaaggacgaacttaaagccatcctggagaagcagaaagagtttcatcacgaactctctagcgagtccctgcttaccgaatgtgctaaggagctgtataaacggaacattgcccatcaggaagttctcctgaagaagggaatgatccaccttctcctgaatgatatccttttctaccagagaccgctgaaaattaagaaaagcctcatcgacaactgcccctatgagaattacaagtacgtggataaaaagtctggcgacattaaagtcaagtccatcaagtgtattgcgaaaagcaaccctttctttcaagagttccgcctgtggcagtttgtgtctaatctgcggctttatagaaagagcgatgacaaagacgttacgtccgaacacctcgtgacaaccgatgactacgccaacctgttcacatatctgaataaccgcaaggatatcaaacagtctgtcctcctgaaggagtactttaagattaaaaaggtgaaaaccatcaatggggctgaatatcccgtgcggtggaactacatcgacgatgacaacaagacctatccttgcaatgagacaagatacgatattcttcatgccctgagcaaaacggagctcaagtccgaatggctgacccccgagcgcacataccggctgtggcaccttctctatagcatcgaatctaaggaggaaaccaaaaaggctctgaacaaactgaatctctccgacgatttcacagaggcctttctgaccattaagccgttcaaaaaggagtacggaagctattctgaaaaggccatcaaaaagctgctgtccctcatgagaatgggctacctgtggagcgaggacgaagctattaaacaggtcggcgcggagatcgaaaagacgatcgagggggagctgcctgattatgttcttcaacggctcgaaaaatcccagcataactacaataagatttctgactttagcggactgcccctgtggctcgcctcctatatcatttacggccgccactctgaggctaaagaaatcattcattgggataaccctgagagcatgatggcctacatcaaggacttcagacagcactccatgcggaatcccatcgtggaacaatgtgtgctggagacacttagaaccgtccacgacatttggaaggagatcgggcatattgatgaaatccacattgagctgggacgcgaaatgaaaagcacctctgagcagcggaaggccatcacacagaacgtgctccataatcagaacaccaatatcagaattaaactgctgcttcaagagctcaagaacgacaataacatcacaggcgttcgcccctattcccctatgcagcaggaaattctgagaatctacgaggaaggggctctgcagggcctcacgaaagaggataaggactataatgatattctgaagatcagccaaaccgcccagccgacatctaacgaacttacccggtacaaactgtggctcgagcagaagtatcgctccccctacacaggaaaagcgattagcctgtctaagctgtttaccagcgcttatcagatcgagcacgtgatccctcaatccagatacttcgacgatagcctttctaacaaagtcatttgcgaatccgaggtgaatacgctgaagaaggccatgctcggcatggaatttatcaaaacctgtgggggacagaaggttcactgcacactgctcggcgacgtggagatttacaacgaagaggattataaagccttcgtcaatgagcattacagcaacaatcggaccaagcgcaacaaactgcttatggaagacatcccccaggagttcattaatagacagctgaacgattcccggtatatctctaagatggtgaagcaactcctgagcgctatcgtccgcgggcaggaagaggtggaagccacatccaaatttgttattccttgtaccggaggcatcacggacagactgaagaaagattgggggcttaatgacatttggaacaatctggtgtctccccggttccagcgcatgaacgctctcacaggcagcgagtactttggacactgggagaataaggaaggcaaaagagtcttccaaaccacaatgccgatccagctgcagcaggggttttccaagaagcggattgaccatagacaccatgccatggatgcgctcgtgatcgcctgcgcttctcgcaacatcattagctatctgaataacgagaccgcccaagacaccgaacggagacgcgatcttcggcagaaactgtgtgacaagggaggctccgttagaaaaccttgggatagcttcacacaggacacgcagtacgctctcaaggatatcattgtgacctttaaaaactatgtccgcatcattaataaggccacaaactactacgagcactataaaaccgacgggaagaagggaatgatctctcaaaaaggcgatgagctgtgggcgattcggaagcccatgcacaaagaaacagtgttcgggaaggtgaatctgagacgccctaaacgggtttcccttagcaaggccatcgactctgtcgatgtgatctgcaacagaaagctgaaaaagtacattaaagctcggctcaatgagggcctgcagaagaaacagatcctcaacatttttaaggaagtgaataacgtctgggagggaatcgacgtgaataagattgacatctgggaaatgtccaacgataaagagcccatggttgccacccgcaagcagctggacacgagcttcgatgagaaaaagatcagatctatttccgacacaggcatccaaaagattcttctgaattatctgatcaccaagaacaataaccctgaactcgcttttacccccgaggggattcaggaaatgaatagcaacatctccgagtacaatgatcataagaaacaccagccgatctataaggtgcgggtcacagaacctctgggagccaaataccccattggcaccatggggaacaaccccaagaaattcgtggaggcccaagctggaacaaatctttattttgcgatctacgaggacaaggaaggcaaccgcaattacgatacgattcctctgaacatcgccgctgagagactcaatcagcagctgagcccggttcccgaaaccaacgagaataacacacctctcaaattctatctgtctcccaatgaccttgtgtacgtccctagcgaagaggagcggcattccgggaacaatattcagctggataagaacagaatctataagatggtgtctagcacctccaaacaatgcttctttattcaccatcgcgttgccatctctctggtggacaagaaagagttcagcgcccagaataagatggagcggtccatcgataacgaacaggtcatgattaaatctgtgtgttggaagctcatcacagacagactgggcaatattatcaaggtgattaaatga

SEQ ID NO: 4563 - RNA, 4458 nt, synthetic construct
  misc_feature 1..4458: note = Cas9 variant
  source 1..4458: mol_type = other RNA
atgaagaacatcctgggcctcgacctggggaccaatagcattggatgggccaaaatctccattgatgacaacggcaagtacatcaaagattctattaaacttgggagcagaatcatccccatgtcccaggacgtgctgtctaatttcagcaaaggagtcacactctcccaaacgtctgagcggaccagctttcgcggcgctagacggctgcgcgaaagaacacttctgcggcgcgagagactccaccggattctgcatctgctcgggttcctgcctaagcactatgaaaaggccatcggatgggatcgcaacgacaataaaacctacggcaagtttattaaccatgcggagccgaaacttgcttggtgcaaggataataacggcaaaatgagattcctgtttatggactccttccacgatatgctcagcgaattttctgagaagcatcccgagctgcttgccaatgggaagaaaatccctctggactggacaatttattacctccggaagaaagccctgtataaggctatcaccaaagaagaactggcctggattctcctgaacttcaatcagaagcgcggatactatcagcttagaggcgaagaggatcgggactccgaggctaacaaaaaggaatacctggagctcaaggttatcggggtggaagccacaggagagaaaaagggcaatgatatctggtacaacattcacctggaaaatgggtggatctatcgcagaagctctaaaaacccccttaacgactggctgggaaaggtgaaatcctttattgtcaccacggacctcgatgcggacggcaatcctaagaaggataaagacggcaacatcaagcggagcttcagagccccctctgagggggattggaccctgattaaaaagcgcacagagtccctgctcgaaaatagcggacagaccgtgggccaatttatctacaaccacatcctggaggaaccttccgctaaaattcgggggaatttcatcagaacaattgagcgcaagtattacaaggacgaacttaaagccatcctggagaagcagaaagagtttcatcacgaactctctagcgagtccctgcttaccgaatgtgctaaggagctgtataaacggaacattgcccatcaggaagttctcctgaagaagggaatcatccaccttctcctgaatgatattcttttctaccagagaccgctgaaaatcaagaaaagcctcattgacaactgcccctatgagaattacaagtacgtggataaaaagtctggcgacatcaaagtcaagtccattaagtgtatcgcgaaaagcaaccctttctttcaagagttccgcctgtggcagtttgtgtctaatctgcggctttatagaaagagcgatgacaaagacgttacgtccgaacacctcgtgacaaccgatgactacgccaacctgttcacatatctgaataaccgcaaggatattaaacagtctgtcctcctgaaggagtactttaagatcaaaaaggtgaaaaccatcaatggggctgaatatcccgtgcggtggaactacattgacgatgacaacaagacctatccttgcaatgagacaagatacgatatccttcatgccctgagcaaaacggagctcaagtccgaatggctgacccccgagcgcacataccggctgtggcaccttctctatagcattgaatctaaggaggaaaccaaaaaggctctgaacaaactgaatctctccgacgatttcacagaggcctttctgaccatcaagccgttcaaaaaggagtacggaagctattctgaaaaggccattaaaaagctgctgtccctcatgagaatgggctacctgtggagcgaggacgaagctatcaaacaggtcggcgcggagatcgaaaagacgattgagggggagctgcctgattatgttcttcaacggctcgaaaaatcccagcataactacaataagatctctgactttagcggactgcccctgtggctcgcctcctatattatctacggccgccactctgaggctaaagaaattatccattgggataaccctgagagcatgatggcctacatcaaggacttcagacagcactccatgcggaatcccattgtggaacaatgtgtgctggagacacttagaaccgtccacgacatctggaaggagattgggcatatcgatgaaattcacatcgagctgggacgcgaaatgaaaagcacctctgagcagcggaaggccatcacacagaacgtgctccataatcagaacaccaatattagaatcaaactgctgcttcaagagctcaagaacgacaataacattacaggcgttcgcccctattcccctatgcagcaggaaatcctgagaatttacgaggaaggggctctgcagggcctcacgaaagaggataaggactataatgatatcctgaagattagccaaaccgcccagccgacatctaacgaacttacccggtacaaactgtggctcgagcagaagtatcgctccccctacacaggaaaagcgatcagcctgtctaagctgtttaccagcgcttatcagatcgagcacgtgattcctcaatccagatacttcgacgatagcctttctaacaaagtcatctgcgaatccgaggtgaatacgctgaagaaggccatgctcggcatggaatttattaaaacctgtgggggacagaaggttcactgcacactgctcggcgacgtggagatctacaacgaagaggattataaagccttcgtcaatgagcattacagcaacaatcggaccaagcgcaacaaactgcttatggaagacattccccaggagttcatcaatagacagctgaacgattcccggtatatctctaagatggtgaagcaactcctgagcgctattgtccgcgggcaggaagaggtggaagccacatccaaatttgttatcccttgtaccggaggcattacggacagactgaagaaagattgggggcttaatgacatctggaacaatctggtgtctccccggttccagcgcatgaacgctctcacaggcagcgagtactttggacactgggagaataaggaaggcaaaagagtcttccaaaccacaatgccgattcagctgcagcaggggttttccaagaagcggatcgaccatagacaccatgccatggatgcgctcgtgatcgcctgcgcttctcgcaacattatcagctatctgaataacgagaccgcccaagacaccgaacggagacgcgatcttcggcagaaactgtgtgacaagggaggctccgttagaaaaccttgggatagcttcacacaggacacgcagtacgctctcaaggatattatcgtgacctttaaaaactatgtccgcattatcaataaggccacaaactactacgagcactataaaaccgacgggaagaagggaatgatttctcaaaaaggcgatgagctgtgggcgatccggaagcccatgcacaaagaaacagtgttcgggaaggtgaatctgagacgccctaaacgggtttcccttagcaaggccatcgactctgtcgatattatctgcaacagaaagctgaaaaagtacattaaagctcggctcaatgagggcctgcagaagaaacagatcctcaacatttttaaggaactgaataacgtgtgggagggaatcgacgtgaataagatcgacatttgggaaatgtccaacgataaagagcccatggtcgccacccgcaagcagcttgacacgagcttcgatgagaaaaagatcagatctatttccgacacaggcatccaaaagattctgctgaattatctcatcaccaagaacaataaccctgaactggcttttacccccgaggggatccaggaaatgaatagcaacatttccgagtacaatgatcataagaaacaccagccgatctataaggtgcgggttacagaacctcttggagccaaataccccattggcaccatggggaacaaccccaagaaattcgtggaggcccaagctggaacaaatctgtattttgcgatctacgaggacaaggaaggcaaacgcaactacgatacgattcctctcaatatcgccgctgagagactgaaccagcagctcagcccggtccccgaaaccaatgagaacaatacacctctgaagttctatctttctcccaacgacctggtgtacgttcctagcgaagaggagcggcattccgggaataacattcagctggataagaatagaatctataaaatggtgtctagcacctccaagcgctgcttctttatccaccatcgggtcgccatttctctcgtggacaaaaaggagttcagcgcccaaaacaaaatggagagatccatcgataatgaacaggttatgattaagtctgtgtgttggaagctgatcacagaccgccttggcaacattatcaaagtcatcaagtga

SEQ ID NO: 4564 - RNA, 4458 nt, synthetic construct
  misc_feature 1..4458: note = Cas9 variant
  source 1..4458: mol_type = other RNA
atgaagaacatcctgggcctcgacctggggaccaatagcattggatgggccaaaatctccattgatgacaacggcaagtacatcaaagattctattaaacttgggagcagaatcatccccatgtcccaggacgtgctgtctaatttcagcaaaggagtcacactctcccaaacgtctgagcggaccagctttcgcggcgctagacggctgcgcgaaagaacacttctgcggcgcgagagactccaccggattctgcatctgctcgggttcctgcctaagcactatgaaaaggccatcggatgggatcgcaacgacaataaaacctacggcaagtttattaaccatgcggagccgaaacttgcttggtgcaaggataataacggcaaaatgagattcctgtttatggactccttccacgatatgctcagcgaattttctgagaagcatcccgagctgcttgccaatgggaagaaaatccctctggactggacaatttattacctccggaagaaagccctgtataaggctatcaccaaagaggagctggcctggattctcctgaacttcaatcagaagcgcggatactatcagcttagaggcgaagaggatcgggactccgaggctaacaaaaaggaatacctggagctcaaggttatcggggtggaagccacaggagagaaaaagggcaatgatatctggtacaacattcacctggaaaatgggtggatctatcgcagaagctctaaaaacccccttaacgactggctgggaaaggtgaaatcctttattgtcaccacggacctcgatgcggacggcaatcctaagaaggataaagacggcaacatcaagcggagcttcagagccccctctgagggggattggaccctgattaaaaagcgcacagagtccctgctcgaaaatagcggacagaccgtgggccaatttatctacaaccacatcctggaggaaccttccgctaaaattcgggggaatttcatcagaacaattgagcgcaagtattacaaggacgaacttaaagccatcctggagaagcagaaagagtttcatcacgaactctctagcgagtccctgcttaccgaatgtgctaaggagctgtataaacggaacattgcccatcaggaagttctcctgaagaagggaatgatccaccttctcctgaatgatatccttttctaccagagaccgctgaaaattaagaaaagcctcatcgacaactgcccctatgagaattacaagtacgtggataaaaagtctggcgacattaaagtcaagtccatcaagtgtattgcgaaaagcaaccctttctttcaagagttccgcctgtggcagtttgtgtctaatctgcggctttatagaaagagcgatgacaaagacgttacgtccgaacacctcgtgacaaccgatgactacgccaacctgttcacatatctgaataaccgcaaggatatcaaacagtctgtcctcctgaaggagtactttaagattaaaaaggtgaaaaccatcaatggggctgaatatcccgtgcggtggaactacatcgacgatgacaacaagacctatccttgcaatgagacaagatacgatattcttcatgccctgagcaaaacggagctcaagtccgaatggctgacccccgagcgcacataccggctgtggcaccttctctatagcatcgaatctaaggaggaaaccaaaaaggctctgaacaaactgaatctctccgacgatttcacagaggcctttctgaccattaagccgttcaaaaaggagtacggaagctattctgaaaaggccatcaaaaagctgctgtccctcatgagaatgggctacctgtggagcgaggacgaagctattaaacaggtcggcgcggagatcgaaaagacgatcgagggggagctgcctgattatgttcttcaacggctcgaaaaatcccagcataactacaataagatttctgactttagcggactgcccctgtggctcgcctcctatatcatttacggccgccactctgaggctaaagaaatcattcattgggataaccctgagagcatgatggcctacatcaaggacttcagacagcactccatgcggaatcccatcgtggaacaatgtgtgctggagacacttagaaccgtccacgacatttggaaggagatcgggcatattgatgaaatccacattgagctgggacgcgaaatgaaaagcacctctgagcagcggaaggccatcacacagaacgtgctccataatcagaacaccaatatcagaattaaactgctgcttcaagagctcaagaacgacaataacatcacaggcgttcgcccctattcccctatgcagcaggaaattctgagaatctacgaggaaggggctctgcagggcctcacgaaagaggataaggactataatgatattctgaagatcagccaaaccgcccagccgacatctaacgaacttacccggtacaaactgtggctcgagcagaagtatcgctccccctacacaggaaaagcgattagcctgtctaagctgtttaccagcgcttatcagatcgagcacgtgatccctcaatccagatacttcgacgatagcctttctaacaaagtcatttgcgaatccgaggtgaatacgctgaagaaggccatgctcggcatggaatttatcaaaacctgtgggggacagaaggttcactgcacactgctcggcgacgtggagatttacaacgaagaggattataaagccttcgtcaatgagcattacagcaacaatcggaccaagcgcaacaaactgcttatggaagacatcccccaggagttcattaatagacagctgaacgattcccggtatatctctaagatggtgaagcaactcctgagcgctatcgtccgcgggcaggaagaggtggaagccacatccaaatttgttattccttgtaccggaggcatcacggacagactgaagaaagattgggggcttaatgacatttggaacaatctggtgtctccccggttccagcgcatgaacgctctcacaggcagcgagtactttggacactgggagaataaggaaggcaaaagagtcttccaaaccacaatgccgatccagctgcagcaggggttttccaagaagcggattgaccatagacaccatgccatggatgcgctcgtgatcgcctgcgcttctcgcaacatcattagctatctgaataacgagaccgcccaagacaccgaacggagacgcgatcttcggcagaaactgtgtgacaagggaggctccgttagaaaaccttgggatagcttcacacaggacacgcagtacgctctcaaggatatcattgtgacctttaaaaactatgtccgcatcattaataaggccacaaactactacgagcactataaaaccgacgggaagaagggaatgatctctcaaaaaggcgatgagctgtgggcgattcggaagcccatgcacaaagaaacagtgttcgggaaggtgaatctgagacgccctaaacgggtttcccttagcaaggccatcgactctgtcgatgtgatctgcaacagaaagctgaaaaagtacattaaagctcggctcaatgagggcctgcagaagaaacagatcctcaacatttttaaggaactgaataacgtgtgggagggaatcgacgtcaataagattgacatctgggaaatgtccaacgataaagagcccatggtggccacccgcaagcagcttgacacgagcttcgatgagaaaaagatcagatctatttccgacacaggcatccaaaagattctgctgaattatctcatcaccaagaacaataaccctgaactggcttttacccccgaggggattcaggaaatgaatagcaacatctccgagtacaatgatcataaggaacaccagccgatctataaagttcgggtgacagagcctcttggagccaagtaccccattggcaccatggggaacaaacccaagaaattcgtcgaggcccaagctggaacaaacctgtattttgcgatctacgaagacaaggagggcaatcgcaactacgatacgattcctctcaatatcgccgctgaaagactgaaccagcagctcagcccggtgcccgagaccaatgaaaacaatacacctctgaaattctatctttctcccaacgacctggtttacgtgcctagcgaggaggaacggcattccgggaataacattcagctggataagaatagaatctataagatggtctctagcacctccaaacaatgcttctttattcaccatcgcgtggccatctctctcgttgacaagaaagagttcagcgcccagaacaagatggaacggtccatcgataatgaacaggtgatgattaaatctgtctgttggaagctgatcacagacagacttggcaacattatcaaggtgattaaatga

SEQ ID NO: 4565 - RNA, 4461 nt, synthetic construct
  misc_feature 1..4461: note = Cas9 variant
  source 1..4461: mol_type = other RNA
atgaccaagatcctgggcctcgacctggggacaaacagcattggatgggccatcagagaggatgaaaatgagggcgtgaaccagattatcgacaaaggggtccggattttctccgaaggagttaagtctgagaatggcaaagaaatcagccgcgctgccgagagaacggcgtaccggtccgctcgcaagatcaaatatagacggaaacttcgcaagtacgagaccctgaaagtgctctctgtgaacgggatgtgccccctgagcgtcgaagaggtggaacaatggaagaaatccggatttaaggagtatcctcttaatccggagttcctgaactggctcagaacaaatgaagataaaaacattaatccctactttttccgggacaaggcctctaagcagaaagttaccctgtttgagctgggccgcgccctctatcacatcgctcagagacggggcttcctgagcaaccgccttgatcagtccgccgaaggggtgtttgaggaacataatcctcaaattcagaacctgatcgaggacctcgatagctctaatacaattctgaacgagcttaaggaatactatatcaatctgggaattatcgacgagtccgaaaagagcggcttcaagaaagatctcgacgagggggaaaagaacctgaaaaagctgtacacctctctcgtctccatcacaaagaaaaacgctaatgatattgagacctgtaagcaggagctgatcgccagacttaacaaaaaggaagacctgggaaaagtgaagggcgagattaaggatatcagccaggcgatgctcgacgggaattttaaaacgctgggacaatacttcttttctctttataacaagacccggattcgcaatcagtacacatccagagaggagcactatctggaagagttcatcatcatttgccagacccagggcatcgaggaaattaacacaaatgagaaactccccgaaaagaaatttaccggcctggccaaggacctgtaccgggctatcttcttccaaagacctctcaagagccagaaagggctgattggaaagtgttcctttgagaaaaacaagtctcgctgcgccgttagccatcccgattatgaggagttccggatgtggtcctaccttaatacgatcaaaatcggcacacagagcgaaaagaccctgagatttctcacactggaagagaaacttaagctggtgcctaagttctatcgcaaaaacgactttaatttcgaagtcctcgctaaggagctggtggagaaaggggcctcttttggatactacaagtccagcaaaaagaacgagttcttttattggttcaattacaagccgaccgattctgtgagcgcgtgtgtcgtttccgcctctctggaaaacgctattggcaaagactggaagaccaaaacatttgaatatcaaacgagcaataccaagaaagaggaagtgacaaagtccgtgaactacaaggatctctggcatctgcttagcgtcgccacctctgacacatatctgtacgatttcgctatcgagaaactcaagctggagcccaaaaacgccaaggccttttccaaaaccaagctgaagaaagacttcgctagcctttctctcgcggccattgctaagatcctgccttatctgaaacaggggctcctgtactcccacgccgtgttcattgccaatatcgaaaacattgttgatgctgacatctggaaggataaagagcagcagaagtttatccaaagcaagattgtggaccttatcgacaattacctggtcgaaaaatccaagctcgagattatcaactgcctgctgaaaatttataatacggaagatatcgagggacggaaggtgtactattctaaagaggccgaaagccttttcgaggcggacctcagaaagaaactggttcccttttacaaggctaacacaatctccgaacagcaggagcaggagattatcttcaaggatctgtttcctgtgctcattgaacaactgaaaaagcaggagttcatcaaaattgtccgccttgacaagaaaatcgaagcctttctgaagggcgagaatgaagagggccagatcttctgtaactatcccgagaagtttaaaaagctctaccacccgtctgatattgaagtgttcaaaaagaaaatcattaaggacgagtgggggaatgaaaaggtcgtgctgggaagccctctgaccacctccatcaaaaaccccatggccatgcgggcccttcaccagctcagaaaggttctgaatacactgattctcgatggccaaatcgacgagaaaacccgcatccatattgaaatggctcgggagctgaacgatgctaataagagaaaagggatccaggactttcagaaggagcgcgaggaactttataagatttacgaagccaaaatcaaggagctgtaccaggtgaaaacaggaaaggaactcctgcacgtcacggatgaggacctgcaaaaattcgagtgggcgcttgaacagaccaaggatggccggattatcacaaaggaggaactcattaaatataagatctgggaggagcagaaccatatctgcatttacaccgggaaaacaatcagcattgactcttttctgggcggaaatcctaagttcgacatcgaacacaccattcccagatccatcagccaagataactctctgatgaacaaaacgctctgtgacaaggatttcaatcggtccgtgaaaggcaagaagatgcccgttgagctgagcaactataatgaaatccttcctcgcattgcccactggaaaaagcaggctgaggaactgaccagacagatcgagacaatttctcggagcatcaaatccgccgctaccaaggtggccaaagacaagaacattagaaagcgccattacctcacactgaaacgggattatatccaggggaagtacgacagatttacctggggagagccgaaagtcggcttcaagaatagccaaatccccgatacggggattatcacaaaatatgcgcaggcctacctgaagtcttactttaagcgcgtggaatccgtgaaaggaggcgctgttgccgagttcagaaaactttgggggattcaggagagctttatcgacgaaaacggcttcaagcactttaaggaaaaagatcggtccaagcatacccaccatacaattgacgctatcaccattgcctgcatgcctaaggataaatatgacctgctcgcccacgcttggcgcctggaggatgagcagaataagaaagcggccaaggctctcatcgaacaagccaaaccctggaagaccttcaaagaggacatcgaaaagattgaggccgaaatcctggtctctcactttacacctgacaacgtgaagaaacaggctaagaaaattcttagagtgcggggaaagaaacagtacgtcgccgagatcgagcgcaatgcgaacggcaaggctattcccaagaaagatgccagcgggaagatcatctataaactgaatgaaagaggaaacaagattccgatcctccagcaaggcgacacgattcgggggtccctgcatcaggattctatctacggagccattaaaaatcctctgaacaccaatgagatccgctatgtgatcagaaaggaccttgaaagcctgaaggctaacgatattgagaacatcgttgacgagaatgtgaaagccaaggtcaaagaagcggtggctaacaagattctcctgatctcctctaatccccagcagaaaaacaagttcgccgagggcaagaatgtttggatgaacgaagagaaaaagattcctatcaataaagtgcggatttacgccaacagcgtcaagaatcccatcgaaatcaaaaagcactccacactcagcaaatctaagcatgagcacaagcagaccgtgtatgggcagaacgatgagaattacgctatggccctgtacgaacttgacggcaaacgcgagtttgaactgattaacaatttcaacctcgctaagctgctgaaacagggacaaggctattaccctcttcacaaggagaaagaaatcaaggggaagaaagttctgattcccatcgagaagagaaataaccgggatgtggtcctcaaaagaggacaacaggtggtgttctatgacaagacagtcgaaaattccaaagatattagcgaaatcgttgactttcgcggccgggtgtacctgatcgaggggctcaccattcagagacaaaaggacaagaaaacgggaaaggtgaacgaatatggcatcattcagctgcgctacttcaaagaggcccggaagtctgaagagatctccaaagatagctttaagccggacggggagttcaagattaacgaaaataaacctacaagaaagatgaaccataatcagtttaccgcgttcgtcgagggcatcgattttaaagtgcttccctctggaaagttccagaaaatctga

SEQ ID NO: 4566 - RNA, 4464 nt, synthetic construct
  misc_feature 1..4464: note = Cas9 variant
  source 1..4464: mol_type = other RNA
atgaagaacgtgctgggcctcgacctggggagcaattccgtcggatgggcccttgttaaaaccgaggataacggcaatcccatcgggtctattaagatgggaagcagaatcattcctatgtcccaggacatcctgggctctttcgaaaaaggggatacagtgagccaaacggctcagcggaccctctaccgcggaaagagacggctgattgagcgccacgtgcttagacgggaacgcctgtgcagagtcctccatatcatgaactttctgccggaccacttcgataaactgctcggctgggacaagacagataataagacctatggcaaatttatcgacgattccgagcccaagctggcctggcggcagaacaaaaatgaaaaggagaaaatggagttcgtgtttatggactctttccatgaaatgcttagcgattttgcgaagcaccagcctcaactgattgctaacgggaagaaagttcccctcgactggacaatctactatctgcgcaagaaagcccttacccagctgatttccaaggaggaactcgcctggatcctgctgaatttcaacaaaaagagaggatactatcagctccggggcgaggaggaagaggaacagcctaccaaaaaggaggaatacaaggtgctgaaagtcattagcgtggatgctgacgaggggcaaaagggaaatggcatctggtataacattcatcttgaggacgggggaatctacaaacgcaagtctgatacacccctgtacgactgggttggcaaaacgctccagctgatcgtggtcaccatttatgaaaaggatggcaagacacctaaaatctttgactccgggaagcagaatccgagctacagacttcccaaagaggatgactggggactgattaagaaacggaccgaatctcagatccaatccagcggcaagacagtgggggccttcatttatgataacatcctctctaagcctgacgataaaatccgcggaaatctggtgagaaccattgagcggaagtactataaaaaggaactgatcgagattctccagcagcaagctaaataccacgacgagctgcacaaccagaaccttctggaatcctgtgccaaggagctctatgcgcataatgatgtcagatacaacgaagttgtcaagagcaatatgatccaccttcttgtggacgacattatcttttaccagcgccccctgaaatccaagaaatctctcatcgccaactgcaagtatgagagctacgaatatgtggataaagagacgggcgaggtgaaggaaatgcctattaaatgtatcgctaagtccaatccctactatcaggagttccggctgtggcaatttattcataacctgagactcagcgacgttgtgacacgcgaagatgtcaccgcccagtacctgtctacaccgcaggactattgcaatcttttcacctacctgaacgatcggaaggagatcaaacaggacattctcctgaaggatttctttaaaatcaagaaagtgcaaattgacaaggagaaggttttccctatcgaatggaattacatcaaagatgctaccaagacatatccctgtaacgagacgagatacgaactgctttccgccctcaaacgcgcggggatggacaagcagtggctggatgacacccctaatatgcagtatcggctgtggcacctcctgtacagcgtggaggaacaggaggagtctgccaaagctcttagaaagctgtatgataacgacaattttgtcagctccttcctcaagattaaaccctttaagaaatgctacggagcctattctgaaaaggctatcaaacgcctgctgacacttatgcggatgggcaaggcctgggacgagcaagccattgatgctaagaccctcaaatgtatccagcagattatcacaggcaacatcgacagcaagctgaaagaaaagattgatgactccagatacgtgctgcaccatgtcagcgatttccaggggctccccacctacctggcgtcttatgtgatctacggacgccactccgaggttacggacattcggtgctgggatacacctaaagaccttctgaagtttatctgtggcttcccgcaacatagcctcagaaatcccattgtggaacaggtcatcctggagaccctgcgggtggtttatgatatctggaaagccgagaagcacattgacgaaatccatgtggaggtcgctcgcgaaatgaagctgaccgcccagcaaagaaacgaggccaacctccggaatctgaacaatgaagctacaaacctgagaattaaatacctcctggaggagcttaagaatgatacctttatcaaagacgtgcgccctctgtctcccatgcaccaggaaaagatgcggatttatgagcaggccgtgctcgggaacctgaataaacaggataaggactacgacgatatcatcaagatttccaaaaaggaaagacctacaagcgcggagctgatccgctataaactttggctcgagcaaaagtactgctccccctacacgggaaaagctatttctctgagcaagctgttcaccacagcctatcagatcgaacacgttattccgcagtccagatactttgacaactctttcaataacaaggtcatctgtgagagcgaagtgaataaagagaaggataaaatgctcggctatgaatttattaaggggcggggcggagaccgcatctactgcaccgcccatggcaaagaggtgacaatcctgaaggaggaagagtataagcagttcgtcaacgaacactacgctcataataaaagaaagcgggataaccttctggccgagaatattcctgaatccttcagctctcgccaactcaacgacaccagatatatcacgaaaaccattatgtccctgctgagcaacgtggttcggcagcagggggaggaggaagctacagccaagaatcttctgccctcttccggagcggtgaccgataaactcaagaacgactggggcctgaaggatgtctggaatacaatcgtgacccctcgctttgagagactcaacaaactgagcgggacgaatgacttcggagaaatgaaggaggaaaacggcaatcggtactttcagacaaacgttccctctgagtacgagaaagggttcaagaaaaagcgcattgatcacagacaccatgccatggacgctcttgtgatcgcctgcaccacacggaatatggtcaactatatcagcaatgtgaacgctaattcccctaaacaaagagaagacctgcgccagctcctgtgtgataagaaccggattatcaataagccctggaacacctttacccaggacgccctgaaagcgcttaacgatattgttgtgagcttcaagaataacgtcagaatcattaatcgcgccacaaaccggtaccaaagatatgacaaaaatggcaagaaaatgatctgctctcagaagggaaacgatatgtgggctatccgcaagtccatgcacaaagagacggtgtttggccgggtgaatctgattagaaaggaagccctcccgatcgctaaagccctggacaacattagcgccatctgtaatgctcagctccgcgcgtacgtcaacgatctggttgacaagcatttcaataaaaagcagcttgtggcccactttaagtccctggattataaatggaaccggcaagacgtgtctaaggtcgaggtgtggattagctccgatgacaaaacccctatggttgctgtgagaaagcccctcgatacatctttcgacaaaaagaagatcgccagcattaccgacacagggatccaggccatcctgctgaattaccttgagtccaaaggaggcgatgctctggtcgcctttgcgcccgaagggattcaggagatgaactctaatatcgaactctataacaatggaaaggctcataaacctattaagaacgtgcggctgagcgagaccctcggcgccaaataccaggttggggaacgcggcgccaagacgaaaaagtacgtggtcgctgacaagggaacaaacctgttctttgccatctatgaggatgaggaaggcaaaagatactattactccgtgccgcttcgggaggcgattgaacgccaaaagcagaaactgagccccgttcctgagtataatgaaaagggggtggctctgaaattctacctctctcccaacgacctggtctatgtgcctaccgaggaggaaagaaccatgggaacatgccacatcgataagacccggatctacaagatggtgtccagctctgagaatagatgttgcttcgtcccctccacaattgccaaagttatcgccgacaaggtggaacttctgagccacaacaaaattgagaaggctatcacgggcgaatctattaaagaggtgtgttggaagctcaaggtcgatcgcctggggaatatcctcaacgtgatcaaatga

SEQ ID NO: 4567 - RNA, 4464 nt, synthetic construct
  misc_feature 1..4464: note = Cas9 variant
  source 1..4464: mol_type = other RNA
atgaagaacgtgctgggcctcgacctggggagcaattccgtcggatgggcccttgttaaaaccgaggataacggcaatcccatcgggtctattaagatgggaagcagaatcattcctatgtcccaggacatcctgggctctttcgaaaaaggggatacagtgagccaaacggctcagcggaccctctaccgcggaaagagacggctgacagagcgccacgtgcttagacgggaacgcctgtgcagagtcctccatattatgaactttctgccggaccacttcgataaactgctcggctgggacaagaccgataataagacatatggcaaatttatcgacgattccgagcccaagctggcctggcggcagaacaaaaatgaaaaggagaaaatggagttcgtgtttatggactctttccatgaaatgcttagcgattttgcgaagcaccagcctcaactgatcgctaacgggaagaaagttcccctcgactggaccatttactatctgcgcaagaaagcccttacacagctgatctccaaggaggaactcgcctggattctgctgaatttcaacaaaaagagaggatactatcagctccggggcgaggaggaagaggaacagcctaccaaaaaggaggaatacaaggtgctgaaagtcatcagcgtggatgctgacgaggggcaaaagggaaatggcatttggtataacatccatcttgaggacgggggaatttacaaacgcaagtctgatatccccctgtacgactgggttggcaaaacgctccagctgatcgtggtcaccatttatgaaaaggatggcaagacacctaaaatctttgactccgggaagcagaatccgagctacagacttcccaaagaggatgactggggactgattaagaaacggaccgaatctcagatccaatccagcggcaagacagtgggggccttcatttatgataacatcctctctaagcctgctgacaaaatccgcggaaatctggtgagaaccattgagcggaagtactataaaaaggaactgatcgagattctccagcagcaagccaaataccacgatgagctgcacaaccagcatcttctggaatcctgtgcgaaggagctctatgcccacaacgacgtcagatacaatgaagttgtcaagagcaacatgatccatctgcttgtggatgacattatcttttaccagcgccccctgaaatccaagaaatctctcatcgacaattgcaagtatgagagctacgaatatgtggataaagagacgggcgaggtgaaggaaatgcctattaaatgtatcgctaagtccaacccctactatcaggagttccggctgtggcaatttattcacaatctgagactcagcgacgttgtgacacgcgaagatgtcaccgcccagtacctgtctacaccgcaggactattgcaaccttttcacctacctgaatgatcggaaggagatcaaacaggacattctcctgaaggatttctttcaaatcaaaaaggtgcagattgacaaagagaaggttttccctatcgaatggaactacatcaaggatgctaccaaaacatatccctgtaatgagacgaagtacgaactgctttccgccctcaaaagagcggggatggacaagcagtggctggatgacacccctaacatgcagtatcgcctgtggcacctcctgtacagcgtggaggaaaaagaggagtctgccaaggcccttcggaagctgtatgatgacgacaattttgtcagctccttcctcaaaattaagccctttgaaaaatgctacggagcttattctgagaaggctatcaaaagactgctgacacttatgcgcatgggcaaggcctgggatgaacaagccattgacgctaagaccctcaaatgtatccagcagattatcacaggcaacatcgatagcaagctgaaagagaagattgacgattcccggtacgtgctgcatcacgtcagcgacttccaggggctccccacctacctggcgtcttatgtgatctacggaagacattccgaagttacggatattcgctgctgggacacacctaaagatcttctgaagtttatctgtggcttcccgcaacacagcctccggaatcccattgtggagcaggtcatcctggagaccctgagagtggtttatgacatctggaaagccgaaaagcatattgatgagatccacgtggaagtcgctcgggagatgaaacttaccgcccagcaacgcaacgaagccaatctcagaaacctgaacaatgaggctacaaacctgcggattaagtacctcctggaggaacttaagaatgacacctttatcaaagatgtgagacctctgtctcccatgcaccaggagaagatgcgcatttatgaacaggccgtgctcgggaacctgaataaacaggacaaggactacgatgacatcatcaagatttccaaaaaggagcggcctacaagcgcggagctgatcagatataaactttggctcgaacaaaagtactgctccccctacacgggaaaagctatttctctgagcaagctgttcaccacagcctatcagatcgagcatgttattccgcagtcccgctactttgataactctttcaataacaaggtcatctgtgaaagcgaggtgaataaagaaaaggacaaaatgctcggctatgagtttattaaggggagaggcggagatcggatctactgcaccgcccacggcaaagaggtgacaatcctgaaggaagaggaatataagcagttcgtcaacgagcattacgctcacaataaacgcaagagagacaaccttctggccgaaaatattcctgagtccttcagctctcggcaactcaacgatacccgctatatcacgaaaaccattatgtccctgctgagcaatgtggttagacagcagggggaggaagaggctacagccaagaaccttctgccctcttccggagcggtgaccgacaaactcaagaacgattggggcctgaaggacgtctggaatacaatcgtgacccctcggtttgaacgcctcaacaaactgagcgggacgaatgatttcggagagatgaaggaagagaacggcaatagatactttcagacaaacgttccctctgagtacgaaaaagggttcaagaaaaagcggattgaccaccgccatcacgccatggacgctcttgtgatcgcctgcaccacaagaaatatggtcaactatatcagcaatgtgaacgctaattcccctaaacaacgggaggatctgagacagctcctgtgtgacaagaaccgcattatcaataagccctggaacacctttacccaggatgccctgaaagcgcttaatgacattgttgtgagcttcaagaacaacgtccggatcattaatagagccacaaaccgctaccaacggtatgataaaaatggcaagaaaatgatctgctctcagaagggaaacgacatgtgggctatcagaaagtccatgcataaagaaacggtgtttggccgcgtgaatctgattcggaaggaggccctcccgatcgctaaagccctggataacattagcgccatctgtaatgctcagctcagagcgtacgtcaacgacctggttgataagcacttcaataaaaagcagcttgtggcccattttaagtccctggactataaatggaaccgccaagatgtgtctaaggtcgaggtgtggattagctccgacgataaaacccctatggttgctgtgcggaagcccctcgacacatctttcgacaaaaagaagatcgccagcattaccgatacagggatccaggccatcctgctgaattaccttgaatccaaaggaggcgacgctctggtcgcctttgcgcccgaggggattcaggaaatgaactctaatatcgagctctataacaatggaaaggctcacaaacctattaagaacgtgagactgagcgaaaccctcggcgccaaataccaggttggggagcggggcgccaagacgaaaaagtacgtggtcgctgataagggaacaaatctgttctttgccatctatgaggacgaagagggcaaacgctactattactccgtgccgcttagagaagcgattgagcggcaaaagcagaaactgagccccgttcctgaatataacgagaagggggtggctctgaaattctacctctctcccaacgatctggtctatgtgcctaccgaggaggaacgcaccatgggaacatgccacatcgacaagaccagaatctacaagatggtgtccagctctgaaaatcggtgttgcttcgtcccctccacaattgccaaagttatcgccgataaggtggagcttctgagccataacaaaattgaaaaggctatcacgggcgagtctattaaagaggtgtgttggaagctcaaggtcgacagactggggaatatcctcaacgtgatcaaatga

SEQ ID NO: 4568 - RNA, 4464 nt, synthetic construct
  misc_feature 1..4464: note = Cas9 variant
  source 1..4464: mol_type = other RNA
atgaagaacatcctgggcctcgacctggggagcaattccgtgggatgggcccttgtcaaagttgaggaaaacggcaatcccattgggtctatcaagatgggaagcagaattatccctatgtcccaggatattctgggctctttcgagaaaggggacaccgtgagccaaacagctcagcggacgctctaccgcggaaagagacggctgatcgaacgccacgtgcttagacgggagcgcctgtgcagagtcctccatatcatgaactttctgccggcccacttcgatcggctgctcggctgggacaaaaccgataataagacatatggcaagtttattgacgattccgaacccaaactggcgtggcgccagaacaagaatgagatggggaaaatggagttcgtgtttatggactctttccatgaaatgcttagcgattttgctaagcaccagcctcaactgatcgccaacggcaaaaaggttcccctcgactggaccatttactatctgagaaagaaagcccttacacagctgatctccaaggaggaactcgcttggattctgctgaatttcaacaaaaagcggggctactatcagctccgcggggaggaggaagaggaacagcctaccaaaaaggaggaatacaaagtgctgaaggtcatcagcgtggatgccgacgagggacaaaagggcaatgggatttggtataacatccatcttgaggatggaggcatctacaaaaagaaatctgacattcccctgtacgactgggttggcaagacactccagctgatcgtggtcaccacgtatgaaaaagatgggaagacccctaagatttttgactccggaaaacagaatccgagctacagacttcccaaggaggatgactggggcctggtgaaaaagcggacagaatctcagctccaatccagcgggaaaaccgtgggagctttcatctatgataacattctgtctaagcctgacgataagatccgcggcaatctggtcagaacaatcgagcggaaatactataagaaagaactcattgagatcctgcagcagcaagccaagtaccacgacgagcttcacaaccagaacctgctcgaatcctgtgcgaaagagctgtatgcccataatgatgttcactacaacgaagtgattaagagcaatatgatcaaccttctggtgaatgacattatcttttaccagagacccctcaagtccaaaaagtctctgatcgctaactgcaaatatgagagctacgaatatgtcgataaggagaccggggagattaaagaaatgcctatcaagtgtattgccaaatccaatccctactatcaggagttccgcctgtggcaatttatccataacctccggctgagcgacgtggttacgagagaagacgtgacagctcagtacctttctaccccgcaggattattgcaatctgttcacatacctcaacgaccgcaaggagattaagcaggatatcctgctgaaagacttctttaagattaaaaaggtccaaatcgataaagagaaggtgttccctatcgaatggaattacattaaggacgccaccaaatcctatccctgtaacgagacccggtacgaacttctcagcgcgctgaagagagccggaatggataaacagtggctggacgatacacctaatatgcagtatcgcctctggcatctgctttactctgttgaggaaaaggaggagagcgctaaagccctgcggaagctctatgacgatgacaagtttgtgacgtccttcctgaaaatcaagccctttaacaaatgctacggcgcttattctgaaaaggccattaaaagactgcttaccctcatgcgcatgggcaaggcctggaatgagcaggctatcgatgcgaagacactgaaatgtattcaacagatcatcaccgacaacgtcgacagcaagctgaaagaaaagattgatgactcccggtacgtgctccaccacgtcagcgatttccaggggctgcccacataccttgcctcttatgtgatctacggaagacactccgaggttaccgacattcagtgctgggatagccctgaagacctgctcaaatttatccgcgatttcaagcaacattctctgcggaacccgattgtggagcaggtcatcctggagacgcttagagtggtttatgacatctggaaagctgaaaagcacattgatgagatccatgtggaagtcgcccgggagatgaagctcacagcccagcaacgcaatgaagctaacctgagaaatctgaacaatgaggccaccaacctccggattaaatacctgcttgaggaactgaagaatgacacctttatcaaagatgtgagacccctctcccctattcaccaggagaagatgcgcatctatgaacaggcggtgctgggcaacctgaataaacaggacaaggattacgacgacatcattaagatcagcaaaaaggagcaccccacaaacgctgagcttattcggtataaactctggctggaacaaagatactgttccccttacaccgggaaggccatctctctgagcaaactcttcacaacggcctatgagattgaacatatcattccccagtcccgctactttgataattctttcaacaataaggttatctgcgaggctgaagtcaacaaggccaaaggaaatatgctgggctatgagtttatcaagaaacaagggggccagaagatttactgtacccagcttggaaaagctgtgacaatcctgaaggaggaagcctataagcagttcgtgaacgagcactacgcgcataacaaaagaaagcgggacaatctcctggccgaaaacattccggagagcttctccagccgccagctgaatgataccagatatatcacaaaaaccattatgtctcttctgtccaacgtcgtgcggcagcaaagcgaagaggaggctacggccaagaatctcctgccttcttccggcagcgttaccgaccgcctcaaaaacgattgggggctgaaggacgtgtggaatacaatcgtcacccccagatttgaacggcttaacaagctgtctggaacaaatgatttcggcgagatgaaagaagagaacgggaatcgctactttcagaccaacgtgcctctcgaatacgagaagggattcaaaaagaaaagaatcgaccaccggcaccatgctatggatgccctggttattgcgtgcacgacacgcaatatggtgaactatatcagcaatgccaacgctaactcccccaagcagagagaggacctgcggcaacttctgtgcgataaaaatagaattatcaacaagccttgggacacctttacacaggacgccctcaaggctctgaatgatattgtcgtgagcttcaaaaacaatgttcgcatcatcaaccgggccaccaatagataccagcgctatgacaagaacggcaaaaagattatcttttctcagaaaggggatgacatgtgggccattcggaagtccatgcacaaggaaaccgtgttcggcagagtcaatctcatccgcaaagaggtgctgcccattgctaaggcgcttgataacatcagcgccatttgtaatgctcaactgcgggcctacgtgaacgacctcgtcgataaacattttaataagaaacagctggttgcccacttcaagtccctgaactataagtggaatagacaggacgtgtctaaagtggaagtctggatcagctccgataacaagacaccgatggtggctgttcgcaaacctcttgacacgtcttttgataagaaaaagatcgccagcattaccgacacaggaatccagaccattctgctcaattacctggagtccaagggcggggatgcgtctgtggctttcgcccccgagggaatccaagaaatgaacagcaacattgagctctataataacggcaaagcccataagcccatcaaaaatgtccggctgtccgaacctcttggggctaagtaccaggtgggagagagaggcgccaaaacaaagaaatacgttgaagcggacaaggggaccaacctgtttttcgctatctatgaggacgaggaaggcaagcggtactattacagcgtgccgctgcgcgaggccattgaaagacagaaacagaagctctctcccgtccctgagtataatgaaaaaggagtggccctgaagttctacctttcccccaacgatctggtttatgtgcctacggaggaggaacggacaatgggaacctgccacatcgacaaagctcgcatttacaagatggtcagctctaccgggtgttcctgctactttgtgcccagcacattcgccaaggtgatcgtcgataaagttgagctccaatctctgaataagatggaaaaagctattaccgacgagtgtatcaaggaagtgtgctggaaactcaaggtggatagactgggaaacatcattaatgtcatcaagtga

SEQ ID NO: 4569 - RNA, 4485 nt, synthetic construct
  misc_feature 1..4485: note = Cas9 variant
  source 1..4485: mol_type = other RNA
atgaagaacatcctgggcctcgacctggggaccaatagcattggatgggcccttatcgataacgagtcccacagaattatcaaatctggcagccggattatccccatggacgctgccacaatgggggattacgaaaagggaaatctgaaatccgcggactggaagcgcacgtctttcagaggcatgcggcgcctctatgagagagctaaactgcggcgcgaaagacttctgcgggtgctcaacatcctggggtttctgcctgaggagttccgcagacagattgattttgaacatcacccgggacaattcatcgacggcaaggagcccctcattgcctaccatcacgatgaaaatggccagcgggtctttagctatatgtccgccttcgaggaaatgctgaccgactttcgcgctacacagtctgagcttgttagagatgggcggcgcgtgccttacgactggaccatctattacctgagacataaggccctcacacagcccgtgaccaaagaggaactggcttggattatccttaacttcaatacaaagcggggatattaccaactgagaagcgagtccgaagaggtcaccacgaacaaaaatgaagagtacgccgagctcaaggtggttagcgtggaaaagaccggcgaggataagaagcgcgcggggtattactggtatacaattacctacgacaacgaagccgagcagaaaatcacatctaccatccctccccggcagattggagataaggtcgaactgatcgtgacgacagctagagacaaagccggcgagattaagaaatccgttcgcagccctaaggaggacgattggaccctgatgaaaaagcggacagaacacaatatcgaggaagaggaatgcaccgtggggtcttatatttaccagcacatcctcgctgacccgaccgtcaaggtgagaggaaaactggtgcatacaatcgagcgcaagttttataaaaaggagcttaaacaaattctgaacaagcagaaggagttcatccccgaactccaggatgcctccctgtacgaagcgtgtattaaagagctttaccggaataacgaggcccacatccagagcattgctaataaggactttacggatctgttcgtcaacgacatcatcttttatcaaagacctctcaaatctaagaaatccaccattagcaactgcccctacgaatcctattactataagaataaggagacaggcgaactgatccgcaaacctattaagtgtatcgccaaatctaaccccctgtaccaggagttccggctctggcagttcgttcataatctgagaatttataagaaaagcgaagaggtgtccggccgccttcaaaccgatgtggacgtcacagatcggtttctgaccacgccggacgattacgctaaactcttcagctggctgaacgacagaaaggagatcaaacagaaggaacttctgcggtacgaggcctttgggctctctaaatcctatggagactaccgctggaatttcgtggaagataagccttatccctgcaacgagacactgcacgaaattaatagacggatgaaaagcatcctgtctgacaagaaactcagctccgaggcctaccagcagctgtggcacatcctttattctattgatgaccctatcgagattagaaaggctctgaccagctttgcgcaaaaccaggaaatcaattccgatgacttcgttaacgccttttaccagtatgtgcccgagaagaccaaaagctacggcgcttactctgaaaaggccattaaaaagctcctgcccctgatgcgccgggggtcctattgggccatcggaaatatcgatgagaaaacacatagacgccttgacaacattatcaatggcgtcgctgatgacagcatttctacctgtacaagagaaaagctcaacaatctgacggatatcaccatgtgccaggggatgcctctgtggcaagcctgttacgcggtgtatgaccggcactccgaggctgccgatacaaccaagtgggagcagccggacgacattgatacatacctcagcaccgaactgaaacagcattcccttcgcaaccccatcgttgagacggtgatctctgaaaccctgagagtcgtgcgggacatttggaaggcctatggacgccctgaggagatccacgtcgaactcggcagaaacctgaaacaggatgctaagagccggaaacaagacgccattcgcatggctgagaatgaacagacaaacctgagaatccgggcccttctccaggagctgtccaatcccgaatgcggcgtggagaacgttcgccctcattctcccagccagatggagctgctcaagatttacgaaaatgaggtgctgcaatccaccgatgacatcccggaagagatcagcaacattatcaaggatcttgggaaaacagactctaagaaaagaccttccctgagcgatattaccaagtatcggctctggctggaacagaaataccagtctccctacacgggacacatcattcctctgtccaaacttttcacacccgcgtatcaaatcgagcacgtcattcctcagagcagatactttgacgattctatcagcaataaggtgatctgtgaggccgaagttaacaaagagaaggaccgcatgctcggctatgagttcattatcaataaagggggatccattgtgaagggcagctttgggcagcagttcaaaatctttgataaggtccaatacgaagacttcgtgaaacagcggtatgctcataacaagaccaagatgaaaaagctgctgatggacgatattcccgacggcttcatccagagacagctcaatgattctcgctacatgtccaaaaagatcattagcatcctgtccaacattgtgcgggaagacggagagaaagaggccacatctaagcacatcattgttaccagcggcgctatcaccgatagacttaagaaagaatgggggatcaaggacgtctggaatgatattatcgccccgcgctttaaacggctgaacaagctcacagactccaataactatggaatggagacggaaaaagagggcagacaatacttccagattaacgtgcctaccgagctgtctacagggctgatcaagaagcgcattgatcatcggcaccacgcgatggacgccatcattatcgcttgcaccacaagaaatcatgtgaactttcttaataacagcaccgccgcttccgatcagaaagacatccggcgcgacctccagcacacgctgtgtacaaagaccaaaaccgattctaatggaaactacgtctggagattcaataagccctgggacacatttacccaagatacacggcaggaactggagggcattatcgtgagcttcaaacagaacctccgcattatcaataagatgtccaactattaccaacattatgttgacgggagaaagacgattagccggcagaataaaggcgatggatgggccatcagaaagtctctgcacaaagccaccgtgtccggcaaggtcaaccttaaacgcagcaagacagtggggtttaaggaagctctgaatgactggtctgcgatcaaagataagacctccaaagccattctccagaagatcattgctcagtacaaaaactatgaccccaagacaatcttcaaatactttaaggatcggaatttcaaggttgagggaaaagactttagcaagctggaagtgtattacaacacctctgataaagagcctatgtccgcccatagagtcaacattgacacgaccttcgatgagaaggaaatccgcagcatcacagacaccggcattcaaaagatcatgctgaagcaccttcacacatacgacgatgcccaggggaagacccatccggaggctgccttttcccccgaaggaattgagaaaatgaatcagaacatccggatgctgaatggcgggaaggaccacaaacctattttcaaggtgagaaaagcggaaatcctcggcatgaagttcgctgttggagagcgcggccataaggataaaaagtgggtggaggccgacaaagggacaaacctgtttttcgccatttatgaaagcgaggaaaataagcggtcttacagctccatccccctcaacgaggctatcgatagactgaaacgcggagaaaatattgccgacgagagagatcagaacggcaataaacttctgtttgtcctctctcctatggacctggtgtatgtgcccgatcctgacgatgcgcacatcgacgaggtcaaggggaacaataacattttcaagatggttagctgcaccggaacggaatgctactttgtgcccgagacatatgctaatgtgatctgtaagggcaaagaactggagtccaagaacaaagtcgagtcttacgatgggattaatatcaagaaaagctgctataagatcaccgtggaccggcttggcaaggttcgcaaaattttcaagggatga

SEQ ID NO: 4570 - RNA, 4491 nt, synthetic construct
  misc_feature 1..4491: note = Cas9 variant
  source 1..4491: mol_type = other RNA
atgaagaccatcctgggcctcgacctggggacaaacagcattggatgggccaaagtgtgcgtcgatgacaatggcaactaccttagagatatcaagctggggtcccggattatccccatgtctcaggacgttctcggaaatttcgataaaggcgtgacggagagccaaacctccgtgcgcacagggtttagaggagtccggcgcattagagaacggtctctgcttcgcagagagcggctgcaccgcgtgctccatgttctgggctatctgcctccgcactacgacagcgctatcggctggaacaagaatgaaccctccacctatgggaaattcctcaaccatggagagcctaagctggcctgggaacacaaggaggatggctctatgagatttcttttcatggagagctttcatgaaatgatggcggacttcgctaaatcccagcccagcctggtgtctgatgggaagaaaatccctctcgactggacaatttactatctgcggaagaaagccctttcccagcccatccgcaaggaggaactggcctggctcctgctgaattttaaccagaagagaggatactatcaactccggggcgaggaggatgacgataatcctaccaaatgtgaagagtactacgaactgaaggtcgtggggattgaggctgacgaagagggaaagaacggcaatacatggtataacgttaaacttgagaatggctggatctaccgcagacagagcaaaattccgctggacgattggatcgggaaggtgcgggagttcattgtcaccacggaatatgaaaaagacggaatcaccctcaagaaggataaaaacggcgacgtgaagagatcttttcgctcccccagcgaggatgactgggggctgcggaaaaagagaacagaaaaacttctggattcttccaagatgaccgtgggagccttcgtctacgaccacctcctggctgagcctagcgataagatccgcggcaaatttattcggacaatcgagagaaagtattacaaaaaggaactgtatgccattctctgcgagcagtccaaataccacgaggaactgcgctctggggactaccttaataagtgtgcggaggaactgtataagaacaaccagccccatcggaatagcctcctgaccaaagatcttgcctacctgctcctggaggacctgatcttctatcaaagacctctcaagacgaaaaagtccctgattgctgaatgcccctacgaggcctataaatacgttgacaaggaaacaggagagatcaagcgccagggcatcaaatgtattgctaagagcaacccgtattaccaggagtttcggctttggcagttcatctctaatctgagactcttcaacaaagccgatgacaaggaagtgaccgcggattacctgcctacacaagacgattatgtgcgcctgtttgcctaccttaatgaccggaaagagattaaccaggaaaccctcctgaaggagttctttaaactgaagaagatcaccgtcaattccgaaaaagtgttccccattagatggaactatatcgaggataaggagaaaaagtacccttgcaatgaaacacggcacgagctcctgcttgctctggaccgcgccagaatcgatcatagctggctcgaaaaacccggccaggagtatcggctgtggcatctgctttactctgttgaaagcaaggaggagacgaaggaagctctcagaaaactgaaggacgatgacgcctttgtggagtccttcctgaaagtcaagccctttaaacgcgaatatggggcctactctgagaaggctattaagaaactcctggcggtgatgcggatgggaagcctttggagagaaaccgatatctgtgacacaaccaagggcaacattacaaaaatcctgcaaggggagattgacgagaagctcaaagaaaagatctccgccagcgtttcttcctacaatcagctgagcgatttccagggactgcctgtgtggcttgcttgctatgtcgtgtacggccgccactctgaggccgccgaaattcagcactggaagaccccggagtccctcctggcttatatcaacgggtttaaacaacacagcctgagaaatcccatcgtcgagcagtgtattctcgaaacgctgcggacagtgcatgacatctggaaggaggttggccacattgatgaaatccatgtggagcttggacgcaacatgaaatccaccgccgaccagagagcgcggatttctgaaaatgtcctgcgcaacgagaacaccaatctcagaatcaagagcctgctgcttgagctcaaaaacgatcctaatatcaaggacgtgcggccctactcccctatgcagcaagaaaaactgcgcatttatgaggaaggcgttctgcaggagctcacaaaggatgacaaggatttcaccgaaatcacaaaaatttctacgatggctcagcccagcgccaaggagctgcagagatacaaactttggctggagcaaaagtatcggtccccgtacaccgggaaaagcatctctctcacaaagctgtttacctccgcctaccagattgaacacgtgatccctcagagccgctatttcgacgattctttttccaacaaggtcatctgcgagagcgaagtgaatagcctgaaagacaacatgcttggatacgagttcattaagaatcacggcggggaaatcattcattgtacaatgctgggagatgtgaaagttctcagcgagtccgagtataaggctttcgtcaacgaccactacgcccataataaaagaaagcgggaaaacctgctcctggaggacatcccccaggaatttcttaatagacaaatgaacgatagccgctatatttctaaggtggtgaaagctctgctctccaatatcgtccgggccgagggcgaggaagaggcgaccagcaagttcgtggtttcctgctctgggggcatcacggacagactgaaaaaggattggggactgaacgacgtgtggaataaaattgtctaccctcgctttgaacggcttaacagactgaccggcacagaggccttcgggcagtgggaaaacaaggatggaaagcgcgtgtttcagaccgctgttcccctcgagctgcaacggggcttcaataaaaagagaatcgaccaccgccaccatgccatggatgctctcgtgattgcctgcacaagccggaacatcattaattatctgaacaatgagtccgcgaacaatcctaaaaagagagaagaccttcggcagaaactgtgtgataagaaccgcaccatcagaaagccctgggagacgtttacacaggacgccaccgctgccctcgaagatgtcattgtgtctttcaaaaattacgttcggatcatcaacaaggctacaaattactatgagcgctacgacgtggaagggaaaaaggtcattgccgagcagagaggagacgatatgtgggccatccggaaaccgatgcacgaggctacctattacggcagagtgaacctgcgccggaagaaaaaggtgaatctgagagtcgcgcttgaaaacattagctccatctgcgacaataagctgcgcatttatatcaacgggctcgttgagaaaggctttaacaccaagcaaatcctggataaattcaagaatacaaacgaccatttttctatgcagaaaattgataaggtggaaatctggcagttcacgaatgaggaagagaagctcgtggccacccggaaacctctggacacatcttttgataccaagaaaattgcttccatcacagacaccggcattcagacgatccttctgaactacctggagacaaagggaggggatagcaccatcgccttcacccccgaaggaattgtcgagatgaatcaaaacatctctaaatataataacggcaaggaacacatgcccattctcaaggtgagactgtacacaaaacttgggaagaaaatccctgttggacagaccggctgtaaggccaaacagttcgtgattgctgaggccgggacaaatctgtactttgcgatctatgaggacgaagagggcaagcgctcctaccggacgattccgctcaacgaagtcgtggagagactgaagcagggactcagccccgttcctgagaaaaatgataaggacgtgcatctgaaattctatctttctcccaacgatctggtctacgtgcctatcgaagacgagcacgaatccctggctaaggaccacatctataaatttgttgatagctctggcaccacagccaatttcattccccatcgctccgccaacgtgatctttgagctcaataagaaagacgctgaaaagttctgcagcgggtccattatccaaaacgagtacggagtcggcagctctcagagcaagaatcagaaagccattaccggggaaatgatcaaggcggtgtgtagaaaactggaggtggatcggcttggaaacgtcatcaaggttatttga

SEQ ID NO: 4571 - RNA, 4497 nt, synthetic construct
  misc_feature 1..4497: note = Cas9 variant
  source 1..4497: mol_type = other RNA
atgaagcacatcctgggcctcgacctggggaccaacagcattggatgggccgtgatcagagctcatcaggatgccgacggccacacaacgcttcaagatattctggcggctgggtcccggatcattcccatggacgccgccaccctcacagatttcgacaaaggaaatgctcgctctggcaccgccgagagaaccagctttcggtccatgcgcagacggcgcgaaagacagctgcttcggcgcgagagactgcatcgggtcctcatgctgctggggttcctccctcagcactacgctaactctctgacacgctatggagaatttgccgataatagagagtgcaaacttccgtgggttaaagacgaaagcgatggcaagtaccatttcctgtttcaggacgcgttccacgagatgtgtgaggattttcggcaactcgctccccagtgggtggctgacggcaaaaaggtgccttatgattggacactgtactatcttcgctgcaaggccctgtccagaaaaatctctaaggaggaactcgcttggatcctgctgagcttcaaccagaaacgggggtactatcaggccagagacgaagaggacgaggtcaccacgaataagctcgaagagtactacgcgggaaaagtggttcgcgtggatgacaccggcgaacggaaggggaagaacgtctattacgatattacactggagaatggatgggtgtatagatacgccgctcgcatctatcccgactgggttggccaagtgaaagaatttattgtcaccacaacccttaaccctgatgggacgcccaagacagacaaagccggagaggtgaagcggtccttcagaatgcctaaagatgacgattggaccctgatcaagaaaaagaaggagcgcgacattgatcggagccaggaaacaatcggccagtacatttatcacgctctcctgaaagacccgtctcagaagatcagaggcaaacttatcgggaccgtggagcgcaagtactacaaagacgaactgcggcggattctcgatcgccaaatccagtttcatcccgagctgcgggacagagaactgtattacgcctgtctccaggagctgtatccttccaatgtcgccttccggaacacccttgttaatcgcgattttacatacctgttcctcgacgatattctgttctatcaaagaccccttaagagcaagaaatctcagatctccgactgcccttacgaggaacacttttatacggataaggagaccggagaacggattagcgtgcccgtgaaatgtatcgctgtctctcatccgctgtaccaggagtacagactctggcagttcatccaaaacctgcgcatttattgccgggaagcgagaatcgacggcaatctgatgattgattgggaggtgacaaacgagctcctgcagaccgaagaggacaagacagccctttttgattggctgaatgacaaagaatccgttaagcagcctgagctcgtggctttcctgctgggaggaaaggccaacaaaaagcagatcaaagcctaccgctggaactatatggatgacgacaccaagggctacccctgtaatgagacgagagctagccttctcaaatatctgcgggaagcccaaacagattcctcttttctgacccgcgagagagaagaggcgctctggcacattctgtacagcatctccgacaagggggaacttaagagcgctctgggaaaattcgccgtcaagcacggcctcaacgagcggtttgtgaccgttttctctaaatttcctcccttcaagaaagattatggctcctacagcgccaaggctctgaaaaagctgcttcccctcatgcgcatggggcatcactggcaggaggcctcttttatccctagcacaagacagcggatggaaaagttcattaatggagagtacgacgattccatcgacaaacgcacctatgaaaagctggagtctctgacagaagtgagccagtacagaggcctcccggggtggctggcttgctatgtcgtgtacgatcggcattccgagggacgcgacattgagagatggacgagcccctctgatatcgactcctatcttgcccaatttaaacagcacagcctgcataaccctattgtcgaacgggtggttctcgagaccctgagaacagtgcgcgatatctggaagcaggtcgaccacattgatgaaatccacatcgagctgggccggaatatgaaacttcccgcggacaagagacgccagatgaccgaacaagcctggaagaacgagcagacaaatctccggattaaagctctgctgctcgagttcgccagacctgggtacgacatcgaaaacgtgcgcccctattctccgtaccagcaagatcagctgcggatttacgaggaagctgttcttggcgccaatgagtgtcctgacgatatctccgcgattctgaagaaattcaacggactcaatccccctaccagcgccgaggtgctgagatataagtgctggctggaacagaaataccgctccccctatacgggccggaccatccctctttctaagctctttacaagcgcttacgagatcgaacatattatccccaagcagagatatttcgacgattccttttctaacaaagtcatttgtgagagcgaagtgaataagaaaaagggggccatgctgggatacgagttcatcaaatcctatcacggcgctagcattaccctgaacagagggggaacagcctctatcttttccgtggaggcctacgaaaatttcgttaaggagcattacgctcacaaccgcggcaagatgaaaaagctcctgatggacgatgtcccggacagctttatctctagacaacttaacgattcccggtatattagcaaactgatgaagtctatcctcagcaatctggtgcgcgaagagggggaaaaagaggcgatttccaagaacctgatcgtgtgcaccggcggaattacggacagacttaaaaaggattggggcatccacgacgtctggaatgacatcattttccctcggtttaagagactggatgagatggacagctctcatacatacatcaccctcaacacacaccgccatcccattccctccatgcctctggagttccagcgggggtttagcaaaaagagaatcgatcaccgccatcacgccatggacgctattgtgatcgcctgcgccacccggaatattgttaactatctcaataacgaatccgctagacacgatgccaaaacctctcgcatggacctgcagcggcttctgtgtacagcgaatagaaagctcatcgataaaccgtggaagacgttcacccaggacacatgcaaggtgctggaagatatgatcgtcagctttcaacgcaccctgagaattatcaacaaaacaaagaattactatcttcggttcgaggacggaaagaagcgcagagtgctgcagaccaaaggcgataactgggctattcggaagcccctccataaggaaacgttctacggggagatcaatctgcgcagaattgagacactctccctgaacaaagcccttgaacggatccctgacatcgttgagagagatctgcgcaagaaactctctgaactgctgagccttggatataatgccaagcggattaaaggctactttgaggagcacaaggaagagtggtccgacgtgaacctgtctaagatcaaagcctactatttcaccaagcagaaaaacaagagatactttgccgcgcgcaccgaactcgacaccagcttcaataaagataagattgagaacaagatcgctgacacagccattcagaaaatcctgctccaacatctggaagcctatgggaatgatgtcgagcaggctttttcccccgagggcatcgacacaatgaaccggaatattagacagcttaacggaggccggagccaccaacctatctacaaggtgcgcgtttatgaagaggccacgaaattcgctgtggggagacggggaaataagtctaccaaatttgtcgaagccgcgaagggcacaaacctgttctttgccatttacgagatctcccaggtggatgggaatggaaaccgccagaccagcagaacattctcttccattcccctgaatgtggctgtcgaacggctcaaacagggcctgcctcccgttccggaggacgaggaagggaacgcccctaagtatgtgcttagccccaatgatctggtgtacctccctaccgagaaggaactgaaacgcagagagatcgctatgcccattgacaagtctcggatctacaaaatggtctcctgtacgggcaaggattgctttttcatcccggccaacaccgccgtgcctattgttgaccgctatgaatacagctccatgaataaaatcgggagagctctcacaggcgagatgattaaggagatctgtctgccccttaagattgatcggctggggcaaatcatcgaaattagcaccttctga

SEQ ID NO: 4572 - RNA, 4506 nt, synthetic construct
  misc_feature 1..4506: note = Cas9 variant
  source 1..4506: mol_type = other RNA
atgaagaaaatcctgggcctcgacctggggaccaacagcattggatgggccgtgatcaataaggctgagaacgaaggcaaagatgtcctttgcgggattgaggccgcgggatccagaatcattcccatggacgctacaatcatgggcgatttcgaaaagggaaattctgttagccagacgaaagaccggcgcgagcacagatccacccggcgcctgtacgaaagagggaagctccggcgcgagagactgaaccgggtgctttctgtgatgggctttctgcctgatcattatgtcagccaactcgaccgctacggcaagttcctgtccaatacagagccgaaactggcctgggtgagaaacgccgattgtaagtatcactttctcttcatggactcttttagcgaaatgctgcaggagttcaaaaccaatagcccccagtacatcagcgaagagtctaaggttccttatgattggacactttactatctgcggaaaaaggctctcacccataaggtgacaaaagaggaactggcctggattcttctgaactttaatcagaagcgcgggtacttccaactcagagacgagtccgaagaggagaaaaagcccagcaaaatccggcagtactttgagcaccagaaggtcgtggatattatcgacaccaacgaggtttataaaggactgaaggtgctgattgtcatcctcgctaatggcatttctgggaagatcttcaaaaaggaaatccctgattggattggagtggagaaagacatcattgtgaaggtcgacatcgataaagacggcaaggataagtttaacgaagacgggtccctgagctgccgcttcaatattcccacggaggccgaatgggataccgagtgggagcttatcaaacagaagacacaaaacgacctggatgcgtctggaaaaaccgttggcgaatacatctttgacacactcctgagaaatcctgagcagaagattcggggcaaacttgtgagaaccatcgaacgccggtattacaaggaggaaattaacgccatcctgaagaaacagaaggagttccatccggagctctccgatagagctctgtatgaaaaatgtgtggaggaactgtaccccaacaatcctgcccaccgcaacatgatgctcattcacgacctgagctatttccttgtcaatgatatcctgttttaccagcggcccctcaagtccaaaaagtctctgatcgacgagtgcccttacgagagccatctttatattgacaagaaatccggggaaagaaagcccgtggctgttaaatgtatcgccaagagccacccgctgtaccaagagttccgcctctggcagtttatttctaacctgcggatctatcagaaaacgaaggaagtgggaaattccctgaaagtcgatgtggacgttacaaacgagttcctcaagggcgaaaatgattacgtggagctgtttgactggcttaacaccaagaaagagattaagcaagaagatttcctgaaatataagccttttgggttcacaaaaggaaatatcaacaattacagatggaactatgtcgaggacaagatttacccctgcaataagacccattacaccatcctcaaaggcctggaaaaggcggatatcacatttgacgagttcattagccacgattctctggccgaagagaacctttggcacatcctctatagcgtgtcctctaaagaggaactgaagcatgctctggagagctttgccgacaaacgcgggctctccattaagttcgtcgatgcttttatcaatacgcctgccttcgaaaagagctacggagcctattctgctaaagcgattaagaaactgcttcccctgatgcggatgggcaagtactggaaagaggaaaacatctgtgactccaccagagagcgcatcgataagattatcacaggcgagtatgacgaaaacattcgggacagagtgcgggaaaagagcatcaatctcaccgatattacactgttccgcgggctgcccctttggctcgcctgctacgttgtgtatgacagacactctgaagctggaaacaccgagcggtggacgtcccctagcgatatcgaccattacatcagaaaatttaagcagcactccctgcgcaatccgattgtcgagcagatcgtgctggaaacactccggaccgttagagatgtgtggaccgaggtcggcgggattgacgaaatccatgtggagctgggacgcgaaatgaaaaacccctctgataagagacggaaaatgagccttcagatgcaagagaatgagaacacaaatctgcgcattaaggccctcctggccgagttcatcaaccctgagctgggcatcgaaaatgtgagaccctactccccttctcagcaggaccttctccggctgtatgaggaaggggcttggaacagccccgagattgatgagaaacaggttgacgaaatgctggccatcctcaagaagtttaatgagaccgattccagcaaacgcccgacaaagtctgaaattaaaagataccggctgtggcttgagcaaaagtatcgctccccttacacgggcacccccatccctctgagcaaactcttcacaaccgcgtatgaaattgagcacgtcatccccagatctcggtttttcgacgattccctgacaaacaaggtgatttgtgagagcgaagtgaataagctgaaaggaaacatgcttggctacgagtttatcaagtctcactatggggaaaaagtccagctcagctccggaagcgaggtgcagatcttctctgttaatgactacgagaagtttgtgaaagaccattactccaagaacaaggctaaaatgaagaaactgctgatggatgacattcctgaaaagttcaccgagcgccagatgaacgatagcagatatatctcccggctcattgtctctctgcttagcaatatcgtgagagaaaaaggcgagcaagaatccatttctaagaacgttctggtgtgcaccgggggagtcacggaccgcctcaagaatgattggggcgtgaacgacgtttggaataaaatcatcctgccccggtttaagagaatgaacgagattacagatagcaccgactacacatccgtgaatacctctgggcacatcattccggccatgcctctgcatcttcagaaaggcttcaacaagaaacgcatcgatcaccggcaccatgccatggacgctattgtcatcgcctgtgctggaagaaatatcgtgaactatctgaataaccagagctccaagagcgatgtgtctcgccacgacctccggaatctgctctgcgagaaggacaaatccgatagaaaggaactgattatcaaaccctgggacacgtttacacaggatgtctacagcgttctttcttccattatcgtgagcattaagcaaaacctgcgcgtgatcaataaaaccaagaacatttatcagcggaaagaggacggcaaggtcatcatctctaagcaggaaaacaatattaactggtgggccatcagaaaacccctccataaggagacagtgtccggggaagttaatctgcggaaagagaccaccattagcctgaaggaggcgatcgataaccctgcccgcattatcgacaaagatttcaagaagaaacttagagaactgatcctcatgggatacaatgagaagctgattaaaaagtatttctacgacaacaatgaatcctggcaagatgtgaacctcaaaaagatcccggcttactattttacaaaggacacgaatgatcggtacttcgccagccgctctctgcttgacgagaactttgataaaaagaaaattgaaaataaggtcaccgacacaggcatcagaaccattctgctccggcacctggaggtggaagggggagacagcaaagttgctttctcccccgaaggcctggagagaatgaacaagaatatcgaaatccttaacgggggcaagaaacataagcctatttataaagtgcgcgagtacgagaaggccgaaaaatttgcggtcggaatgcggggcaataaggcctctaaattcgtggaggctgccaaggggacaaacctgtttttcgctgtttatgataatggaaagaaaagatcctttgccaccgtgcccctcaacgaagtcatccgcctgcagaaggagggcctcccttccgcccccgctaacgaagaggggctgcttcctaaattcgtgctgtctcccaatgacctggtgtacgtcccgacggaggatgaactccggagcggactgcttcctgagaaccccgcgcctgaaagaatttataagatggtttcctgcacaggctaccagtgctttttcatccacttctctgtgagcggggtgctgtgtgacaaaaaggagttttccagcctcaataagatggaacgcgccatttctggcgagatgatcaaagagatttgtatccccctgaaggtcaaccggctcggaaaaatcatgtacaatctgtga

SEQ ID NO: 4573 - RNA, 4506 nt, synthetic construct
  misc_feature 1..4506: note = Cas9 variant
  source 1..4506: mol_type = other RNA
atgaagaccatcctgggcctcgacctggggacaaacagcattggatgggccaaaatctccattgatgacaatggcaactaccttagagatatccagctggggtctcggattatccccatgagccaagacgtgctcggaaagttcgataatggcgtcacggagtcccagaccgctgttcgcacagggtttagaggactgcggcgcatcagagaacggtctcttctgcgcagagagcggctccaccgcgtgctgcatgtgatgggcttcctgcctccgcactatgacagcgccattggctggaacaaagaggaaccctccacctacgggaagtttctcaatcatggagaacctaaactggcgtgggagagacagggcgatgggtctatgcggttcctttttatggacagcttccacaagatgatggaggattttgctccccatcagcctgccctggtcgccgacggacgcaagatccccctcgattggacactgtattaccttagaaagaaggctctgacccaacctattaaaaaggaggaactcgcctggatcctgctgaacttcaatcagaaacggggctattaccagctccgcggggaagaggaggaagagaacccgacaaagagagaagagtatcacgaactgaaggtggtttccgtggaggctgccgaggaaggaaaaggcggcaatacctggtacaacgtcaaacttgagaatgggtggatttaccaccggcccagcaaaatcgacctgtctgattgggtgggaaagacgaaacagtttattgttaccatggaatatgaggcggacggcatcacactcaagaaaaacaaggaaggggaggtgaagagatccttccgcgtccctgacgaggatgactggggactgcggaaaaagagaaccgaaagccaacttgaggcctctggcaaaacagtgggggcttttatctacgatcatctgctcgccgaacccgctgacaagattcgcggaaatttcatccggaccattgagagaaaatattacaagcaggaactggccgatatcctgcgcgagcagtccaagtatcacgaggaactccagagcaaaaagattctggcggactgcgccgaggaactttaccggtctaaccaacctcatagagattccctgctcaaaaaggacatggtgtatctgcttctgacggatctcatcttttaccagcgccccctgaaaagcaagaagtccctgatcgctaattgtccgtacgagtattacgagtatgtcgacaaagaaacaggcgagattaagcggcagggcatcaaatgcgttgccaagtctaacccttactatcaagagttcagactctggcagttcgtgctgaaccttcgcctgtacgatcggaccgaagacaaagaagtgacagctgagtatctccccagcaaggaggactacgccagactgtttgtctacctgaatgatcggaaggaaattaaccaggagacccttctcaaagacttctttaagctgaaaaaggtgaaacagcgctccgaaaaggagttccctgttagatggaattatatcgaagataaagagaagaagtacccctgtaacgagacccggcacgaactgctcatggccctggacagagctgggatggagcgcagctggcttgatgacacagcgcggcaatatagactgtggcacctcctgtactctattgaagtgaaagatgaggccgaacgcgctctgagaaaacttaaggacgatgacgagtttgtctccgccttcctcaaggtgaaaccctttaagaaggattatggagcctacagcgagaaagctgttaagaaactgctggccgtgatgcggatgggctctcattggtgcgaagacgatatctgtaaggagacgaaagaacgcatcgagcacattctccagggggacgtcgaggaaaagatcaaggagagaatgaatcataccgcgtatagcctgggagaactttccgacttccagggcctgcctgagtggctcgcttgctacgtggtctacgggcggcactctgaagccacagatattaaacattggaagaccccggagagcctgatggcctatatcaacggctttaaacagcactccctgcgcaatcccattgtggagcaatgtatccttgaaacactcagaaccgttcacgacatttggaaggaggctggacatatcgatgaaatccacgtggagctgggccggagcatgaaatctacgtccgaccagcgcgccagaatgacagaaaacattctgcggaatgagaacaccaatctccgcatcaagagcctgcttatggagctgaagaacgatgctgacattaaagatgtcagaccttactctcccatgcagcaggaaatcctccggatttatgaggaaggggccctgcaagagctgaccaaggaagacaatgattacgaggagatcttcaaaatctccaagattcctcagcccagcgcgaaagaacttctcaagtataaactgtggctggagcagaagtacagatccccgtatacaggaaagcctatctctctcagcaaactgtttacctccgcctaccagattgaacatatcattccccaatctcgctacttcgacgatagctttaacaataaggtgatctgcgagtccgaggttaacgctcttaaaagcaacatgctgggctatgagttcatcaagaatcacgggggagaaattgtgcactgtacactcctgggcgacgtcaaagtgcagaacgaatctgagtacaaggccttcgtgacggaacattatgctaataacaagtacaaaaaggagaaactgcttatggaggatatccctcaggactttctgaatcggcacctcaacgactccagatatattagcaaggttgtcaaaaccctgctctctaatatcgtgcgcacagaagatgagatggaaaccacatccaagttcgtggtcagctgcaccgggggcattacggaccggctgaagaaagattggggacttaacgacgtgtggaatagcatcgtttacagcagatttgagcgcctgaacgaactcaccaagtccgatgccttcggccggtgggagaataaagaggggaagagagtgtttcaaacaagcgtccccctggaactgcagcgcggattcaacaaaaagcggatcgaccatagacaccatgcgatggatgcccttgtgattgcttgtgcctctcggaatatcattaactatctgaataacgagtccgctaacagccctaagaaacgcgaagacctcagacagcagctgtgcgataagaatcggatcattcgcaaaccctgggagtcctttacccaagacgccagagccgctctcgaagatgttgtggtctctttcaagaactacgtgcgggttatcaataaaacaaccaactactatgagagatacggcgcggacggggagaagacgattgccaagcagaaaaatagcgaaatgtgggctgtgcgcaagccgatgcacgaggccaaatattacggacgggtcaacctgcagagaaagacagaagtgcgccttaaagccgctctggaggacatcccttccatctgcaataaggagctccgggattatattaacagactggtgaaatctggcctgaatgcccgccagcttctggcgcactttaagagcaccgactactgttggaacaagcaaaatgtcgataaagttgaagtgtggcggttctccgacgagaaggaacccctcgtggctatcagagagtctctggatacatcttttgacgccaaacgcattgataccatcaccgacacagggattcagaagatcctcctgaactatcttgaagccaaaggcggagatcccgctatcgccttcacgcctgagggcattgcggagatgaatcagaacatggctctgtacaataacgggaagatgcatcagccgatcctgagagtccggctctccaagaaacgcggaaagaaataccaagtgggccagaccgggtgcaaggccaaacagtttgttattagcgaatctggaacaaacctgtatttcgccatctacgaggacgaagatagaaatcggacctataacacaattccccttaatgaggtggctgaacgcctgaagcaaggcctctcccctgtccccgagaagaacgagaaagaagtgcctctgaagttctacctcagccccaatgacctggtttatgtgcctaccgaggaagagatccttatgaaagaatgtaagctgaacaaaaatagaatctacaagtttattgattcttccgggacgacagccaacttcgtcccccaccggagcgcttctctgatctataatgtggacaagaaactcgccgaggcgttttgcaacgacgagattatccagaatgaatacggcgttggatccccgcagagcaagaaccagaaagccctgaccggcgagatgattaaggctgtgtgttggaaacttgaagtcgatagactggggaatatcattcgcgtgatcaagtga

SEQ ID NO: 4574 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggcaatatcaacgatgacgggtccgagcagctggtgaaaattcaggcttctggaagcagaatcattcccatggatgccgcgatgatcggcgacttcaataaggggaactccatctctcaaacagctgaacggacgcgccttagagggattcggcgcctgagcgagagatacctcctgcggcgcgaaagacttcaccggatcctggatattctcggctttctgccttcccatttcgcccgcgacctggatagatatggcaaaatcgtgaaggacaaagagccgaagctcgcctggcggaagaatgaagctgggcagtttgagttcatttttcagaactctttcaaagagatgctggaagattttaagctgaatcaccccaacctgatcaccgacgataaaaaggtcccttacgactggacaatttattacctccgcaaaaagggactgaccagcaagatctccaaagaggaacttgcctggatcctgctcaatttcaaccaaaagagaggctattaccagctgcggggagaggaggaagaggaaaataaaaacaaacaggtggagttttatgctctgaaagttattgccgtggaagatagcggagagaagaaaggcaaggacacatggtacaatgtccatctcgagaacgggtggatctaccgcagaacctctaacatgcccctggactgggtgggaaagacaaaagagttcattgttaccacggatcttgaaaaggacggcacccctaaaaaggataaagaaggcaatatcaagcggtcctttagagcgcccaaggaggacgattggagcctggtgaaaaagaaaacagaagccgacattgatcagacccacaagacagtcgggacctatatctacgacacgctcctgggaaacccttctcaaaagatccgcggccggcttgtgagaacaattgagcgcaagtattacaaggaggaactgaaactcatcctggataagcagaaagagttccatccggaactgcaggaccgggctctctatgccgcttgcgtggaggaactgtacaccattaatgaggcccacagaaacaatatcgggaaccgcgattttacatatcttttcctggaggacattctcttctaccagcggcccctgaagtccaaaaagagccttatcgacaattgtccttacgaagagaaccactgcctggataaggaaaccggagagatcaaatttttccccgtcaagtgtattgcgaaatctcatcctctctttcaagagttcagactgtggcagtttatcgttaatctgcgcatttatcggaagggcctcgcccaggacgtggatgtgaccaacgaactgcttaaaacagaggaagactacgtcgctctgttcgattggctcaatgggaagaaagagatcgaccaaaaggcctttctgaagtatcccccgttcggactgaaaaaggaagtggagaactacagatggaattatgttcaggataaatcctacccttgcaacgagacgcgcagccttatgctcgctcggctggaaaagtgtgacatttccatcgagtttctgaccaaagaaaatgaggaagccctctggcacattctgtattctgtggaggataagaacgagatcgtcaaggcccttcagaaattcgctgacaagcataacctgaatgcgagctttgtggatgttttccagaaatttccctccttcaagaaagaatacggcagctactctgccaaggctatcaagaaactcctgcctctgatgagaatgggcaagtattggtccgaggacagcattgataaagggacacgggaacgcatggacaagatcattaccggagagtacgacgaaaagatcgagaacagagtgcgggagaaggccattcaccttgccgatatctctgagttcaagggcctccccctgtggctggtctgctatatcgtgtacgggagacacagcgaatccaaagaaattgctaagtgggagtctcccgccgacatcgatagctatctcaaatcctttaagcaacatagcctgcgcaatcctattgtcgagcagatcattatcgaaacacttcgggtggttagagacatctggaaacaggtgggaaacattgatgagatccacgtcgaactgggccgcgagatgaagaatccggcggacaaaagacggaagatgacccagcaaatttctgaaaacgagaatacgaacctccgcatcaagtacctgctgacagagttccttaatcccgaatatgaggtggaaaacgttagaccttactcccccagccagcaggatattctccggatctacgaggaaggggtgcttaattctgtctccaacctgcctgaggagatcagcgacattctcaaaaagtttaccgaaaccgatctgaaaaagcgcccctccagatctgaggtgcttcggtataaactgtggctcgaacagaagtaccgcagcccgtatacaggcgaggtgatccctctgggaaagctgttcacccccgcttacgaaattgagcatgttatccctcaatccagatattttgacgattctttcagcaataaagtcatttgtgaggccgaagtgaacaaacttaaatccaatctcctgggccacgagtttatcgtgaagcatcacggggaaattgtcgagctgcccttcgggaaaaaggtgaagatctttacagttgacgagtacgaacagttcgtgaaagataactatagccggacgcgcggcaagatgaaaaagctcctggtcgacgacatccctgaggaatttgtggccagacagcttaacgattctcggtacatttccaaagttgtcaagagcctgctctctaatatcgtgagagagaagggggaagaggaggctatttccaaaaacgtgatcccctgcaccggaggcgttacagaccgcctgaagaaagattggggagtgaatgacgtctggaacaagattatcctgccgcggttccagagacttaatgaactgaccggcacaaacaaatttaccacgatgagcctcaataaccacgagatccctgccatgcccctggaactccaaaagggattcaataagaaacgcattgatcatcggcaccatgctatggacgccatcattatcgcgtgtgccaacagaaatattatcaactacctgaataacgagtctgctaccgccaaggctgaacttagccgctatgatctgcagcggctcctgtgcgacaaagccaagacagatgacaatggcaactacaaatgggtgatcagaaagccctgggcgtccttcacccaggatgtgcacggggtcctggaggacattatcgttagctttaaacaaaaccttcgcgtgattaataaggccacaaaccacttcctgcattataatgaggaaggaaagaaaatctttgtgaagcaggagaaaggcgactcttgggctattcggaagtccatgcacaaagataccgtcttcggggaagtgaacctcagacggatcaagacggttgccctgaatgaggctatgaagaaccctcagagcattgtggtcaaagactttaagcgcaaactcctggaacttctgaatctcggattcgatgccaagagaatcaaaaagtactttgaggacaaccgggagacatggtccgatatcaatctgtctaagattaccgtgtattacttcagcaaagacacaaaggatcgctttttcgccaccagaaaaccgctggacacctcctttgatcggaagaaaatcgaaaacaatattacagacacgggcatccagaagattcttctgagacatctcgagctgaaggataacaatcccgacatcgctttctctcctgatgggatcgacgaaatgaaccgcaatattatccaactcaacaatggcaaatatcaccagcccattatcaaggttcggtggtacgagcaggcggacaaattcgccgtgggacagaccggcaacaagagctccaaatttgtcgaggctgccaaggggacaaacctgttctttgccgtgtacgaatctaatattcttgatgagaaaaccaacacaatcatcaagaagagaaattatgctaccattcctctgaacgttgccatcgaacgccaaaaacagggactgagcgtggcgcccgaggaagagaatggcaacgaccctattttcgtcctctcccccaatgatctggtgtaccttccgacgacagacgagctggctaacggggtggtcgcccagcctctcgataaggaacggatctataaaatggttagctgtaccggaaatgagggccattttattcccgccagaatcgctaaccctattctgcagaccatcgaactcgggtctaataacaaggcccaaaaagcgtggacagacgagatgatcaaggaaatttgcatgcccatcaaggtggatcgcctgggcaatattcttgagtccagctctctgcacaaaaagtga

SEQ ID NO: 4575 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggctccgtgaatgatgacgggtctgagcagctggtgaaaatccaagctagcggatccagaattatccccatggatgccgcgatgattggcgacttcaacaagggaaattctatcagccagacagctgaacggacgcgccttagaggagtccggcgcctgtccgagagatacctcctgcggcgcgaaagacttcaccggatcctggatattctcggctttctgcctttccattttgcccaggacctggatcgccacggcaaaatcgtgaaggggaaagagccgaagctcgcctggagaaagaacgaagctggacagttcgagtttattttccaagactcttttaaagagatgctggaagatttcaaacttaattatcccaacctgatcaccgacgataaaaaggttccttacgactggacaatttattacctccggaaaaagggcctgaccagcaagatctccaaagaggaacttgcctggattctgctcaattttaaccagaagcgcgggtattaccagctgagaggagaggaggaagaggaaaataaagataagctggtggagttctatgctctcaaagtcgtggccgttgaagacagcggcgagaagaaagggaaggacatctggtacaacgtgcatctggagaatggatgggtctaccggcgcacatctaacatgtcccttgattgggtgggcaagaccaaagaatttatcgtgacaaccgacctggagaaggatggcacgcccaaaaaggacaaagaagggaatgtcaagcggagcttcagagcgcctaaggaggatgactggtctctcgttaaaaagaaaaccgaagccgatattgaccagacacacaagaccgtgggagcttatatctacgatacactgcttggcaacccctcccaaaagattagagggcgcctggtgcggaccatcgagagaaagtattacaaggaggaactcaaactgattctggagaagcagaaagaatttcatctcgagctgcaggaccgcgccctttatgctgcctgcatcgaggaactgtaccctatcaacgaggcgcaccggaataacgtcggaaatagagatttcacgtatctcttcctggaagacattctgttttaccagcgcccgcttaagagcaaaaagtctctcatcgacaactgtccctacgaggaaaatcaaggcctggataaggagacaggggagattaaatccttccctgtgaagtgcatcgccaaaagccaccccctgtttcaggagttccggctctggcagtttattatcaacctgagaatctatcgcaaggaccttgctcaagatgttgacgtgaccaatgaactgctcaaaacagaagaggattacgtcgccctgttcgactggctgaacggaaagaaagaaattgatcagaaggcttttcttaagtatcctgtgttcggcctcaaaaaggagatcgagaattaccggtggaactatgttcaggacaaaccctacccgtgtaatgaaaccagatccctgatgctggcccgcctcgagaagtgcgatatttctatcgaatttctgaccaaagagaacgaagaggccctttggcatattctgtatagcgtggaggacaagaatgaaatcgtcaaggctctccagaaattcgcggataagcacgacctgaacgcctcctttgtggatgtcttccaaaaatttcctcccttcaagaaagagtacggcagctactctgctaaggccattaagaaactgcttcctctcatgcggatggggaagtattggtccgaaaatagcatcgacaaaggaacaagagagcggatcgacaagattatcacgggcgaatacgatgagaaaattgagaaccgcgtgagagaaaaggccatccatctggctgacgtttctgatttcaaggggctgcccctctggctggtgtgttatattgtctacggacggcacagcgaggccaaagaaatcatccagtggaagtcccccgcggacattgattcttatcttcgcagctttaaacagcactccctgagaaaccctatcgtggagcagattatcattgagaccctccgggttgtgagagacatctggaagcaagtcggcaatatcgatgaaattcatgtggagctggggcgcgaaatgaaaaacccggctgacaagagaaagaagatgacacagcagatgagcgagaatgaaaacaccaatctgcggatcaagtaccttctcacagagttcctgaaccccgagtatgaagtggagaatgttcgcccttactctccctcccagcaagatattctgagaatctacgaagagggcgtcctcaacagcgtgtctgacctgcctgaagagatttccgatatccttaaaaagtttaccgagacggacctgaaaaagcggcccagccgctccgaagtgctcagatataaactgtggctggagcagaagtaccggtctccgtatacaggagaagtcatccctcttggcaaactcttcacccccgcctacgagattgaacacgtgatccctcagagctgctattttgatgactccttctctaataaagttatttgtgaggccgaggtgaacaagctgaaaagcaatctgctcgggcatgaatttatcgtcaagcaccatggagagattgtggaactgcccttcggcaaaaaggttcgcatctttaccgtggacgagtacgagcagttcgtcaaggataactattccagaacacggagcaaaatgaagaaacttctgatggacgatattcctgaagagtttgtgacccgccaactcaatgactctagatacatctccaaggttgtgaaaagcctgctgtctaacatcgtccgggaaaagggggaggaagaggctatttccaagaatgtgatcccctgcacaggaggcgtgacggatagacttaaaaaggactgggggattaacgaggtctggaacaaaatcattctgccgcgcttccagcggctcaatgaactgaccggcacaaacaagtttaccaccaaaaatgttggaatccaggagatccctacaatgcccctcgaactgcaaaagggcttcaacaagaaaagaattgatcaccgccaccatgccatggacgctatcattatcgcctgtgcgaatcggaacattatcaattaccttaacaatgagagcgccacggctaaggccgaactgtctagatatgatctccagaaaatgctgtgcgacaaggctaaaaccgataacaatgggaactacaagtgggtgatccgcaaaccctgggccagcttcacacaggacacctatctggcgcttgagaatattatcgtgtcctttaagcagaacctgcgggtcattaataaggccacaaacagattcctccactacaacgaggaagggaaaaagatctttgtgaaacaaggcaagggggacaattgggctattcgcaaaagcatgcataaggataccgttttcggagaggtgaacctgcggagaatcaagacggtcgccctcaatgaagctatgaaaaaccctcagtctattgtggttaaggactttaaacggaagctgcttgagctgtggaatctcggcttcgatgccaaacgcatcaagaagtattttgaagacaacagagagacatggtccgatatcaatctgagcaaaattgaggtgtactatttctccaaggacaccaaagatcggtttttcgccacacgcaagccgctggacacctcttttgatcggaaaaagatcgaaaacaatattaccgacacagggatccagaagattcttctgagacacctcgagctgaaagataacaatcccgacatcgctttcagccctgatggcatcgacgaaatgaacagaaatattatccagctcaacaatggaaagtaccaccaacccattatcaaaattcgctggtacgagcaggcggacaagttcgccgtcggccagacggggaacaaatcctctaagtttgtggaggctgccaaaggaaccaatctgttctttgccgtttatgaaagcaacatccttgataagaagacaaacaccatcattaaaaagcggaattacgctacaatccctctgaacgtggccattgagagacagaaacaaggcctgcccgtcgcgcctgaagacgagaatgggaacgatcccatcttcgtgctctccccgaatgacctggtgtatcttcctaccgatgacgaactggctaacggaattatcgcccagcccctcgatcgcggccggatttacaagatggtctctagctccggggagcagtgctttttcatcaaacatatcgttgccaatgtgctggtggacaagtttgagttcagccctctcaacaagatggaaagagctctgacgggcgagatgattaaaatgatctgtattcccatcaaggtcgatcgccttggaaatgtgctggaatcttccagctcttataaaaagtga

SEQ ID NO: 4576 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggctccgtgaatgatgacgggtctgagcagctggtgaaaatccaagctagcggatccagaattatccccatggatgccgcgatgattggcgacttcaacaagggaaattctatcagccagacagctgaacggacgcgccttagaggagtccggcgcctgtccgagagatacctcctgcggcgcgaaagacttcaccggatcctggatattctcggctttctgcctttccattttgcccaggacctggatcgccacggcaaaatcgtgaaggggaaagagccgaagctcgcctggagaaagaacgaagctggacagttcgagtttattttccaagactcttttaaagagatgctggaagatttcaaacttaatcatcccaacctgatcaccgacgataaaaaggttccttatgactggacaatttactatctccggaaaaagggcctgaccagcaagatctccaaagaggaacttgcctggattctgctcaattttaaccagaagcgcgggtactatcagctgagaggagaggaggaagaggaaaataaaaacaagctggtggagttctacgctctcaaagtcgtggccgttgaagatagcggcgagaagaaagggaaggacatctggtataatgtgcacctggagaacggatgggtctaccggcgcacatctaatatgccccttgactgggtgggcaagaccaaagaatttatcgtgacaaccgatctggagaaggacggcacgcctaaaaaggataaagaagggaacgtcaagagatccttccgggcgcccaaggaggacgattggagcctcgttaaaaagaaaaccgaagccgacattgatcagacacataagaccgtgggagcttacatctatgacacactgcttggcaacccttctcaaaagattagagggcgcctggtgcggaccatcgagagaaagtactataaggaggaactcaaacagattctggagaagcagaaagaatttcacctggagctccaggatcgcgccctgtacgctgcctgcatcgaggaactttatccgatcaatgaggcgcaccggaacaatgtcggaaacagagacttcacgtacctgttcctcgaagatattctgttttatcaacgcccccttaagtccaaaaagagcctgatcgacaattgtccttacgaggaaaaccagggcctcgacaaggagacaggggagattaaatctttccccgtgaagtgcatcgccaaatcccatcctctgtttcaggagttccggctgtggcaatttattatcaatctcagaatctaccgcaaggatctggctcaggacgttgatgtgaccaacgaacttctgaaaacagaagaggactatgtcgccctcttcgattggctgaatggaaagaaagaaattgaccagaaggcttttctgaagtaccccgtgttccggcttaaaaaggagatcgagaactatagatggaattacgttcaggataaaccgtatccttgtaacgaaacccgcagcctcatgctggcccggctggagaagtgcgacatttccatcgaatttctcaccaaagagaatgaagaggccctgtggcacattctttactctgtggaggataagaacgaaatcgtcaaggctctgcaaaaattcgcggacaagcatgatctcaatgccagctttgtggacgtcttccagaaatttccccctttcaagaaagagtatggctcctacagcgctaaggccattaagaaactgctgccccttatgagaatgggcaagtactggtctgaaaactccatcgataaagggacacgggcccgcatcgacaagattatcacgggagagtatgacgaaaagattgagaacagagtgcgggagaaggctatccacctcgccgatgttagcgacttcaagggcctgcccctgtggctcgtgtgttacattgtctatgggagacactctgaagcgaaagagatcatccagtggaaaagccctgctgatattgactcctacctgcgctcttttaaacagcatagccttcggaatccgatcgtggaacaaattatcattgagaccctgagagttgtgcgcgatatctggaagcaggtcggaaacatcgacgagattcacgtggaactcggcagagagatgaaaaatcccgccgataagcggaaaaagatgacacagcagatgtccgaaaacgagaataccaacctgcgcatcaagtatctgcttacagagttcctcaatcctgaatacgaggtggaaaacgttagaccctatagcccttctcaacaggacattctgcggatctacgaggaaggggtcctcaattccgtgagcgatctgcccgaggaaatttctgacatcctgaaaaagtttaccgagacggatcttaaaaagcgcccgtccagaagcgagatcctgcggtacaaactctggctggaacagaagtatcgctccccttacacaggcgaggtgattcccctgggaaaacttttcacccctgcctatgaaatcgagcatgtcattccccagtcttgctactttgacgatagcttctccaacaaagtgatctgtgaagctgaggttaataagctcaaatctaacctgctgggccacgagtttattgtgaagcatcacggggaaatcgtcgagctccctttcgggaaaaaggtgagaatttttaccgttgacgaatatgagcaattcgtgaaggacaattacagccggacacgctccaaaatgaagaaactgcttatggatgacatccccgaggaatttgtcaccagacagctgaacgatagccggtatatctctaaggtggttaaatccctcctgagcaatattgtgagagagaagggcgaagaggaagccatctctaagaacgtcattccgtgcacagggggagtgacggaccgcctgaaaaaggattggggcatcaacgaggtgtggaataaaattatccttcctcggttccagagactgaacgagctcaccgggacaaataagtttaccacaaagaacgtcggcctgcaagaaatccccaccatgcccctcgagctgcagaagggattcaataagaaacgcattgaccaccggcatcacgctatggatgccatcattatcgcgtgtgccaacagaaatattatcaactaccttaataacgaatccgctacggccaaggctgagctgagccgctacgacctccagaaaatgctgtgcgataaggccaaaaccgacaataacggcaattataagtgggttatccggaaaccttgggcgtctttcacacaggatacctacctggcccttgaaaacattatcgtgagctttaagcaaaatctgagagtgattaacaaggctacaaaccgcttcctccattataatgaggaggggaaaaagatctttgtcaaacagggaaagggcgacaactgggccattcggaaatccatgcacaaggacaccgtgttcggggaagttaatctgagacggatcaagacggtggctctcaacgaggccatgaaaaatccgcagagcattgtcgtgaaggattttaaacgcaagctgcttgaactgtggaacctcggattcgacgccaaaagaatcaagaagtactttgaggataatcgggaaacatggtctgacatcaacctgtccaaaattgaggtttattacttcagcaaggataccaaagaccgctttttcgctacaagaaagcccctggatacctcctttgaccggaaaaagatcgagaataacattaccgatacaggcatccagaagattcttctgagacacctcgaactgaaagacaataaccctgatatcgcgttctctcccgacgggatcgatgagatgaatcgcaacattatccaactcaataacggcaagtatcatcagcctattatcaaagtgcggtggtacgaacaggccgacaagttcgctgtcggacagacgggcaataaatttagcaagttcgtggaggccgccaaagggaccaacctgtttttcgctgtttacgagtccaacattcttgacaagaagacaaataccatcatcaaaaagagaaactatgccacaattcccctgaatgtggcgatcgaacgccaaaaacagggactgcctgtcgctcccgaggatgaaaacggcaatgacccgatttttgtgctctctcctaacgatctggtgtaccttcccaccgacgatgagctggccaatgggatcattgcccagcctctcgaccggggaagaatctataagatggtcagctcctctggcgaacaatgtttctttattaaacacatcgttgctaacgtgctggtggataagttcgagtttagccccctcaataagatggagcgcgccctgacgggggaaatgatcaaaatgatttgcatcccgattaaggtcgaccggcttggcaacgtgctggagtcctctagctcccataaaaagtga

SEQ ID NO: 4577 - RNA, 4515 nt, synthetic construct
  misc_feature 1..4515: note = Cas9 variant
  source 1..4515: mol_type = other RNA
atgaagagaatcctgggcctcgacctggggaccaacagcattggatgggcccttatcgagaatgatttcaaccggaaagaaggcaagattgaggctctggggtcccgcatcattcccatgtctcaggacatcctcggaaaatttgatagcggcgtgacagtctcccaaacggccgcgagaaccaattaccgggggatccgcagactgtatcagcgggacaaccttcgcagagaacggctgcaccgcgttctcaatattctgggattcctgcctaagcattacgctgagtctatcgattttgaagacagactcggccagttcaaaccggagacagaggtgaagctgccctatcggaaggatagcgacgataactaccactttattttccaggaatcctttaatgagatggtggaagagttccaatttaaaaacccttctcttttctataccaaggccaatggcgagcagagcaaaatcccctacgactggacactgtattacctccgcaagaaagccctgtccaagaagattagcaaagaggaacttgcttggatcctgctcaactttaatcagaagagagggtactatcagctgcggggagaagaggaagccgattctaaagacaagctggaggagtaccatgctctcaaagtctccgatgtgcaagccaccgaagacacaaacgcgaagggcacctggtataatgttattctggagaacgggtggatctaccgcagacagagcaaagactctcttttcgattggaagggaaagacgcgggaatttatcgtgaccacatccctggagaaaggcggggccgtcaagattgacaaagaaggaaatgagaagcgcagcttcagagctgtggattctgagaaagactggatcgccattaagaagaaaaccgaaaacgatctcgctaacgccggcacaaccgttggcgtgtatatctacgagacgctgcttcggaatcctgaccagaagattagagggaaactgatcaagacaatcgaacgcaaatattacctcgaggaactgaaggcgattctggccaagcagatccaagagcacgctgagctccagaaccggtccctgtacaaagattgcattgaggaactttatcagggaaatgaagcccataagaacaatatcaaagagaacggcttcgactacctgtttctcgaggatattatcttctatcaaagaccccttaagagcaaaaagtccaccatctctaattgtccttacgaaagccgcgtctttattaaggacgggaaaaaggagatccagccgattaaatgcatctccaagagcaaccccatttatcaggaatttcggctgtggcagtttatccacaatctgaaaatttacgagaaggaagctatcgatgacggaaaaacagtgatcaacaaggacgtgaccaccgagttcctcaatacacaagaggcctatgccgctctgtttgagttcctgaacgataaggcggaaatttctcagaatgccctcctgaaatactttaaactttccacgaacacccacagatggaataacgtcgaagacaaaaagtacccttgtaacgagacacgcagcgagttcatcaaacggctgtctaagatggatggcattgacctcgggaagaccctgagccccgcttttgaaaaatccctgtggcatatcatttattctgttaaggataaaaagcagtacgtgagagcccttgagacattcgccatgaaaaatggactcgacatcaaccagtttcgcgaaaatttcgagaagttcaagccttatgatagcgcttacggcgcctattccgaaaaagcgctgaagaaagtgctgcccctcatccggagaggcacctactggaagaaagacgctattccggccgccgtccaagagcggatcgtgaacattatgaagcgcatcgaaagcgttgattttaatctggagaagattgagaacttcgctgacgatgacatccctaaacagcttctgaagtcttttgccaaagggaaggatcccatgcagggactcaatacgtatcaggcttgctacgccgtgtacaacagacactccgaagtcagcgacatccaactgtggaaatctcctgaggacattacaaagtatctggattccttcaaacagcatagccttcggaatcccatcgtggaacaggttgtgatggagaccctcagagtcgtgcgcgacatttggcagtactatggcaacggggcgaaggatttcttctccgagatccacgtcgaactgggacgggagatgaagaatgacaaaaagaccagagaacgcatttctaaaagcatcacagagaacgaaaataccaacgagagaatcaagaatattctgaaagagctcatgggcgatgaagccctgcaaggggacatccggccctactccaagggccaccaggatattcttaagctgtatgaggaaggagtgtttgctaacgcccctgagacatacaaaaacatcaagattgacgatatcgaaaagattcgcaagaataactctccgagcaaatccgacatcgttaagtataagctctggctggagcagggctacatcagcccctacacggggtctcctattcccctgtccagacttttcaccacagattatcaaatcgagcatattatccctcggagccgctactttgacgattctatgggaaataaaattatctgtgaatccgctgtgaacgaggaaaagaccaataaaacagcctatgagttcatcaaggaaaacgcgggcagaattatcgacctcgggcagggaaaacaggtccccctgtttgacctggaggcctacgagagccactgccggggctatttcaaggggaataccaagaaactcaagtttctgctttctgaagatattccggagggcttcatcaaccgccagctgaatgacagcagatacatttccaaagtggttacgagcctcctgtctaacgtggtccgggaagagggagagcaagaagctacctccaagaatctggtgcctcttgtgggcacaatcaccagcaaactcaagaaggattgggggctggaggccatctgggacgatctgattgctccccgcttcgaaagaatgaaccagctcacaaaatccaccgactttcggaaggaggttatcgatggacatggcaatagatatttcattaacacggtccctgacgatatcaaaaaggggttttctaaaaagcgcattgaccaccggcatcacgccctggatgcccttgtgatcgcttgtacaaccaaagaccacgtgaattacattacaagcctgaacacccagagaaacaatcgctccctcgtctctaagctgcggaagatcgaagagaaaaccatcaaggacaaaagaacaggacagcccaagacgattaaaatcgcgaaggcctaccataagccttggcccaacttcaccaaagagacatttgaaaagctgagcaaaaccgtggtttccttcaagcaaaatcagcgcattatcaacaaaacaaataacaagacctggggctgggagaaggtggatggggtcatgaaaaaggtgcttaaaaagcaggaaaaacggaattgggctattagaaagccgatccacaaggagacgtattacggcaaagttaagggatttgactctcctaaaggcaagatcacaaccgccacccgcaaaagcctgcgggaaattacaaacgagagacagctcaataccatcacagattccgggattaagaaaatcctgaacaatcatctcaagacgttcattgacgagagcggaaagatcaactttgaacccgccttcaatcaagatggcatcgacctgcttaacaaaaatattcagcagctgaacgaggggaagaatcaccaacccatctataaagtgcggatgtacacccacaacacaatgttttctgtcggagatgaaggcaacaagtccaccaaatatgtgattcctgagagcgggacaaatctcttcttcaacgtttactgggacgaagagaataacaagcgcaattttgagaccgtgccgctgaacagagtcatcgctttccagaagcagacgtctcatattccccggaaagatcgcaccgacgtgcctatcgataatacactgggcagatttcttttcaccctgtcccccgacgatctcgtgtatctgcctacagacgaagagagcgaatcttttaccacattcgagattgactccctcaacagcaagcaggtcgccaatatctacaaatttgttgatggatccggcaccacggggaacttcgtgcccgcggaggctgcccgggtgatcgccaatattaaggacaaaaaggtcagaagcaacttttgcaagcgcaataacctgtctgataaacaacttatcaagaatgagttcggactgggcagccctcagctcaaaaaccagaactccctggacgggcggcagattaagtctatctgttggaaactggaaattaatagacttggaaagatcatcaaggtgattaaatga

SEQ ID NO: 4578 - RNA, 4515 nt, synthetic construct
  misc_feature 1..4515: note = Cas9 variant
  source 1..4515: mol_type = other RNA
atgaagaaagtgctgggcctcgacatcgggaccaacagcgtcggatgggccgttgtgaatcagaacgataagggcgagttcctgtccattgagaaaatcgggtctagaattatccccatgagccaagacgtgatggataagtttggagctggccagacagaatcctctacggcccagcggacccagtaccgcggggtcagacggcttcgcgaaagaagcctgctccggcgcgagagactgcaccgggtgcttcatattctgcacttcctccctcaacattatgacgcggctatcggatggaataaaaaggaaaacaagacatacggcaaatttctgccgggcgttgaggtgaatatcccctgggtcgccaccgatcaggggcaccagttcatttttatggactcctatgccgagatgctgaaggatctcaaacagcatcaacctcacctgttcgaaaagtctagcacacccgtgcctcttgactggaccatctactatctgcgcaaaaaggctctcacacaggccatttccaaggaggaactggcttggatccttctgaactttaatcagaaaagaggatactatcagctccggggcgaggaggttgaagataacaccaagcgcgaggagttctacgccctgaaagtggtcaaggtggaactggacaaagataatacgagcgcgaagacctggtacaaagtgcacctcgaaaacgggtttatttatccctgcccttctgacacaccgatcgattcctgggtcggaatggttaaggacttcattgtgaccacaaccctggagaaggacggcagcgagaaaagaacggccgatggggaaatcaagcggtcttttcgcgctcccaaagaggacgattggacacttctgaagaaaaagaccgaatccgagctcgaaaagagcggaaaacaagtgggcgccttcatctacgacacactgctttctaatcctgatcagaagattatcggcgggctgattaaaaccatcgagagaaagtattacaaaaaggagctcgaacagattctggagacccaacagaagtttatcgctgaactgtccgacaaaaagctgttccaggcctgtgcggaggaactctatccccttaacgatagccatcgggagaatctgctcgagagagacttcaaacacctgtttgtccaggatatcattttctaccatcgccctcttaagaccaaaaagtccctgatctctaactgcacgtatgaataccggaccttttacaagaatggagagaaacaaattagccccatcaagtgtattgccaaatccaaccccctcttccaggaatttagagtgtggcagttcgttcagaacctgcgcatcctgcaacggcagagaagcgagggcgactctatcaagtataatgtggatgtcacagctgagtttctcaaagacgaaaacgacattgccaatctgttcacctggcttaacgagcgcaaggtgatcaaacaggatcagctgctcaagtcctactttaagctgaaagttaataaggaaacaaaagagctggactatcggtggaactacgtggatgacaagaataaagaatatccttgcaacgctaccagaacgcacattcttagcttcctcgagaagtgtaaggaggaaaaacgcatcgaggatgaccggtttgtctactctctgtggcatctgctctatagcgtggtcgaacccattgagctgagaggggcccttgccaagttcgctgaacgcgagcatctgcacccttcctttgtggatgttttcgcgcaattcccgcccctcgagaaagaatacggatcttacagcgagaaggccatcaaacggctgctgcctcttatgagaatgggcgactattggcacgaagataagattgacgtgaagacaaaacagcggatccagcgcatcattgatggggaggctgacgatgacatcacccacagatcccgggaaaaggtcgagaatctcagaagcattaccgactttaaaggactgccgctgtggaaggccggctacgtggtttataaccgccattctgagtccggcgaactcacaaaatggaagacaccccacgagctgagcaattacatccagaacgagttcaagcaatattctcttcggaatcctattgtggaacagatcgtcctggagacactcagagtggtgcacgatctgtgggttaaacatggggacttttccgaaatccacctggagcttggacgcgatattaagaacagctccgacaaaagaaagcggatggccgaacgccagcaagagaatgaaaactctagacagcgggtcctcgagatgctgatcgatctgaaaaaggaggctgccttcgcggacctcaacccctacagcccttcccagcaggaaaaactgcgcattgtggaggatggcgtgcttagatctaatatcgaaattcccaaggacatcgagaagatcacgaaaagcgctaagccgacctcccgggaactgacaaaatatcgcctctggctggatcaaaagtacagaagcccttacaccgggcagcccatttctctggcccagctttttacatccaaatatgagatcgagcatgtcattcctcaggccaagtacttcgacgatagctttaccaacaaggtgatctgcgaatctgaggttaataaagaaaagggatccatgctcgctcacgagttcattctgaaaaacggcgggagcacggtgaatgtcggcggacggcaagtgcaggttctgaagaacgacgcctatgtggaactcatcaatcgcctgtacggcaaaaacaatcccgtcaaggctaagaaacttctggccgaggatatcgacgaggtggttggggacttttctgaaagacagctcaacgatacccggtatattagcagagtggtccagaagctgctgtccaatatcgtgcgcgaggaagacgagcaagagagcacatctaaacacgtgattggatgttccggccaggtcaccacagcgcttaagaaagattgggggctgaacgacatctggaataagattatccagcctcggttcgaaagactcaacgagatgaccgccacggaagattacggagtttggcaaagccccaatcattttcagattcgcgtgccggaggaaatccagaagggcttcaccaaaaagcggatcgaccacagacatcacgctatggatgccctggtgattgcttgcgccacacgctcccatatcaactatatttctaaccggagcgggcaggacagaaatgcgaaatttgagacaacccgcaccgatctccggtccaagctgtgttacaaagagaactctagcggcaataactacaattatatcttcaacaagccttgggacacattcacgcaagatgcccacagagctcttgaaaatattgtcgtgtcccacaagcagaacctgcgggttctcaccaaaacaaataactacacccagtttatcaataaggacggcaaaaaggacctgcagaaacaagtgaagggagatcatttcgccgtccgcaaacccatgcaccaggagacaatctatgggagagtgtctattcggagcatcaaggaagttgctctgaagaaagcccttgagaactggaagcagattgtggaccgcaccctgaaagataagatcagagaactcattggagcctacggcaaatatgacgctcagacgatcctgaagtactttaaggatcgggactataaattcaataacctcaagatcaatagagtcgaggtgtacgagtacgatcataactgcgcggccgttcgcaaatccattggggacgatctgacaatcaagcaaattgaacggatcaccgacgagagcattagaaaaatccttatgaaccacctgtctaattatgatgacaacctcaaggaggctttttcccccgaaggactgatggaaatgaataagaacattaaagagctgaatggcgggaagaaccatcagcctatctacaaagtgcgccttttcgaggatctgggcagcaagtttccgctcggagtctctcacaataaccccgacaaatatgccatcgccgctaagggcaccaatctgttctttgggatttacgaagaccaggagggaaagcggatgttcgattccatccctctcaacattgtgatcgacagactgaaagaaaagaaaagccccgtgcctgagacatataatgagtctaaacttaagtttcacctgtcccccaacgatctggtctacgttcctaccgacgaggaacagaagcaacccgaactcgtggatgtggaccatctgagcgatgagcagaaaggccgcgtctataaggccgtgtccttcacagggaatcgggcgttctttgttaaccacagagtgagcaaggtcattcatgactacgtggagttcggaacgaaaaataagatcgaaaacgatgacgataaacgctctcttaagcacatctgttggaaactgaaggttaatagactcggcgagattaccgacgtgaagcggtga

SEQ ID NO: 4579 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggctccgtgaatgatgacgggtctgagcagctggtgaaaatccaagctagcggatccagaattatccccatggatgccgcgatgattggcgacttcaacaagggaaattctatcagccagacagctgaacggacgcgccttagaggggtccggcgcctgtccgagagatacctcctgcggcgcgaaagacttcaccggatcctggatattctcggctttctgcctttccattttgcccaggacctggatcgccacggcaaaatcgtgaaggggaaagagccgaagctcgcctggagaaagaacgaagctggacagttcgagtttattttccaagactcttttaaagagatgctggaagatttcaaacttaattatcccaacctgatcaccgacgataaaaaggttccttacgactggacaatttattacctccggaaaaagggcctgaccagcaagatctccaaagaggaacttgcctggattctgctcaattttaaccagaagcgcgggtattaccagctgagaggagaggaggaagaggaaaataaagataagctggtggagttctatgctctcaaagtcgtggccgttgaagacagcggcgagaagaaagggaaggacatctggtacaacgtgcatctggagaatggatgggtctaccggcgcacatctaacatgtcccttgattgggtgggcaagaccaaagaatttatcgtgacaaccgacctggagaaggatggcacgcccaaaaaggacaaagaagggaatgtcaagcggagcttcagagcgcctaaggaggatgactggtctctcgttaaaaagaaaaccgaagccgatattgaccagacacacaagaccgtgggagcttatatctacgatacactgcttggcaacccctcccaaaagattagagggcgcctggtgcggaccatcgagagaaagtattacaaggaggaactcaaactgattctggagaagcagaaagaatttcatctcgagctgcaggaccgcgccctttatgctgcctgcatcgaggaactgtaccctatcaacgaggcgcaccggaataacgtcggaaatagagatttcacgtatctcttcctggaagacattctgttttaccagcgcccgcttaagagcaaaaagtctctcatcgacaactgtccctacgaggaaaatcaaggcctggataaggagacaggggagattaaatccttccctgtgaagtgcatcgccaaaagccaccccctgtttcaggagttccggctctggcagtttattatcaacctgagaatctatcgcaaggaccttgctcaagatgttgacgtgaccaatgaactgctcaaaacagaagaggattacgtcgccctgttcgactggctgaacggaaagaaagaaattgatcagaaggcttttcttaagtatcctgtgttcggcctcaaaaaggagatcgagaattaccggtggaactatgttcaggacaaaccctacccgtgtaatgaaaccagatccctgatgctggcccgcctcgagaagtgcgatatttctatcgaatttctgaccaaagagaacgaagaggccctttggcatattctgtatagcgtggaggacaagaatgaaatcgtcaaggctctccagaaattcgcggataagcacgacctgaacgcctcctttgtggatgtcttccaaaaatttcctcccttcaagaaagagtacggcagctactctgctaaggccattaagaaactgcttcctctcatgcggatggggaagtattggtccgaaaatagcatcgacaaaggaacaagagagcggatcgacaagattatcacgggcgaatacgatgagaaaattgagaaccgcgtgagagaaaaggccatccatctggctgacgtttctgatttcaaggggctgcccctctggctggtgtgttatattgtctacggacggcacagcgaggccaaagaaatcatccagtggaagtcccccgcggacattgattcttatcttcgcagctttaaacagcactccctgagaaaccctatcgtggagcagattatcattgagaccctccgggttgtgagagacatctggaagcaagtcggcaatatcgatgaaattcatgtggagctggggcgcgaaatgaaaaacccggctgacaagagaaagaagatgacacagcagatgagcgagaatgaaaacaccaatctgcggatcaagtaccttctcacagagttcctgaaccccgagtatgaagtggagaatgttcgcccttactctccctcccagcaagatattctgagaatctacgaagagggcgtcctcaacagcgtgtctgacctgcctgaagagatttccgatatccttaaaaagtttaccgagacggacctgaaaaagcggcccagccgctccgaagtgctcagatataaactgtggctggagcagaagtaccggtctccgtatacaggagaagtcatccctcttggcaaactcttcacccccgcctacgagattgaacacgtgatccctcagagctattactttgatgactccttctctaataaagttatttgcgaggccgaggtgaacaagctgaaaagcaatctgctcgggcatgaatttatcgtcaagcaccatggagagattgtggaactgcccttcggcaaaaaggttcgcatctttaccgtggacgagtatgagcagttcgtcaaggataactactccagaacacggagcaaaatgaagaaacttctgatggacgatattcctgaagagtttgtgacccgccaactcaatgactctagatacatctccaaggttgtgaaaagcctgctgtctaacatcgtccgggaaaagggggaggaagaggctatttccaagaatgtgatcccctgtacaggaggcgtgacggatagacttaaaaaggactgggggattaacgaggtctggaacaaaatcattctgccgcgcttccagcggctcaatgaactgaccggcacaaacaagtttaccaccaaaaatgttggaatccaggagatccctacaatgcccctcgaactgcaaaagggcttcaacaagaaaagaattgatcaccgccaccatgccatggacgctatcattatcgcctgcgcgaatcggaacattatcaattatcttaacaataagagcgccacggctaaagccgagctgtctagatacgatctccagaagatgctgtgtgacaaagctaagaccgataacaatgggaactataaatgggtgatccgcaagccctgggccagcttcacacaggacacctacctggcgcttgaaaatattatcgtgtcctttaagcagaacctgcgggtcattaataaagccacaaacagattcctccactataacgaggagggaaagaaaatctttgtgaagcaaggcaaaggggacaattgggctattcgcaagagcatgcataaggataccgttttcggagaagtgaacctgcggagaatcaaaacggtcgccctcaatgaggctatgaagaaccctcagtctattgtggttaaagactttaagcggaaactgcttgaactgtggaatctcggcttcgatgccaagcgcatcaagaaatactttgaggacaacagagaaacatggtccgatatcaatctgagcaagattgaggtgtattacttctccaaagacaccaaggatcggtttttcgccacacgcaaaccgctggacacctcttttgatagaaagaagatcgagaacaatattaccgacacagggatccagaaaattcttctgcggcacctcgaactgaaggataacaatcccgacatcgctttcagccctgatggcatcgacgagatgaacagaaatattatccagctcaacaatggaaaataccaccaacccattatcaagattcgctggtatgaacaggcggacaaattcgccgtcggccagacggggaacaagtcctctaaatttgtggaggctgccaagggaaccaatctgttctttgccgtttacgagagcaacatccttgataagaaaacaaacaccatcattaagaaacggaattatgctacaatccctctgaacgtggccattgaaagacagaagcaaggcctgcccgtcgcgcctgaggacgaaaatgggaacgatcccatcttcgtgctctccccgaatgacctggtgtaccttcctaccgatgacgagctggctaacggaattatcgcccagcccctcgatcgcggccggatttataaaatggtctctagctccggggaacagtgctttttcatcaagcatatcgttgccaatgtgctggtggacaagtttgagttcagccctctcaacaaaatggagagagctctgacgggcgaaatgattaagatgatctgtattcccatcaaagtcgatcgccttggaaatgtgctggagtcttccagctcttacaagaaatga

SEQ ID NO: 4580 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggctccgtgaatgatgacgggtctgagcagctggtgaaaatccaagctagcggatccagaattatccccatggatgccgcgatgattggcgacttcaacaagggaaattctatcagccagacagctgaacggacgcgccttagaggagtccggcgcctgtccgagagatacctcctgcggcgcgaaagacttcaccggatcctggatattctcggctttctgcctttccattttgcccaggacctggatcgccacggcaaaatcgtgaaggggaaagagccgaagctcgcctggagaaagaacgaagctggacagttcgagtttattttccaagactcttttaaagagatgctggaagatttcaaacttaatcatcccaacctgatcaccgacgataaaaaggttccttatgactggacaatttactatctccggaaaaagggcctgaccagcaagatctccaaagaggaacttgcctggattctgctcaattttaaccagaagcgcgggtactatcagctgagaggagaggaggaagaggaaaataaaaacaagctggtggagttctacgctctcaaagtcgtggccgttgaagatagcggcgagaagaaagggaaggacatctggtataatgtgcacctggagaacggatgggtctaccggcgcacatctaatatgccccttgactgggtgggcaagaccaaagaatttatcgtgacaaccgatctggagaaggacggcacgcctaaaaaggataaagaagggaacgtcaagagatccttccgggcgcccaaggaggacgattggagcctcctgaaaaagaaaaccgaagccgacattgatcagacacataagaccgttggagtgtacatctatgacacacttctgggcaacccttctcaaaagattagagggcgcctcgtgcggaccatcgagagaaagtactataaggaggaactgaaacagattctggagaagcagaaagaatttcacctcgagctgcaggatcgcgctctttacgccgcttgcatcgaggaactgtatccgatcaatgaggcccaccggaacaatgtcggaaacagagacttcacgtacctcttcctggaagatattctgttttatcaacgcccccttaagtccaaaaagagcctcatcgacaattgtccttacgaggaaaaccagggcctggacaaggagacaggggagattaaatctttccccgtgaagtgcatcgcgaaatcccatcctctgtttcaggagttccggctctggcaatttattgttaatctgagaatctaccgcaaggatcttgcccaggacgtggatgtcaccaacgaactgctcaaaacagaagaggactatgtggctctgttcgattggctgaatggaaagaaagaaatcgaccagaaggcctttcttaagtaccccgttttcggcctcaaaaaggagattgagaactatcggtggaattacgtgcaggataaaccgtatccttgtaacgaaaccagaagcctgatgctggctcgcctcgagaagtgcgacatctccattgaatttctgaccaaagagaatgaagaggccctttggcacatcctgtactctgtcgaggataagaacgaaattgtgaaggccctccaaaaattcgctgacaagcatgatctgaatgcgagctttgtcgacgtgttccagaaatttccccctttcaagaaagagtatggctcctacagcgccaaggctatcaagaaactgcttcccctcatgcggatggggaagtactggtctgaaaactccattgataaaggaacaagagagcggatcgacaagatcattacgggcgaatatgacgagaaaatcgagaaccgcgttagagaaaaggccattcacctggccgatgtgagcgacttcaaggggctgcccctctggctggtctgttacatcgtgtatggacggcactctgaggctaaagaaattacccagtggaaaagccctgccgatatcgactcctaccttagatcttttaaacagcatagcctgcgcaatccgatcgttgagcaaattatcattgagacactccgggtggtcagagatatctggaaacaggtgggcaacattgacgaaatccacgtggagctggggcgcgaaatgaaaaatcccgcggataagagaaagaagatgacccagcagatgtccgagaacgaaaatacaaacctgcggatcaagtatcttctcaccgagttcctgaatcctgagtacgaagttgagaacgtccgcccctatagcccttctcaacaggacattctgagaatctacgaagagggcgtgctcaattccgtgagcgatctgcccgaagagatttctgacatccttaaaaagtttacggagacagatctgaaaaagcggccgtcccgcagcgaaattctcagatacaaactgtggctggagcagaagtatcggtccccttacaccggagaagtcatcccccttggcaaactcttcacccctgcttatgagatcgaacatgtgattccccagtcttgctactttgacgatagcttctccaacaaagttatctgtgaggccgaggtgaataagctgaaatctaacctgctcgggcacgaatttattgtcaagcatcacggagagatcgtggaactgcctttcggcaaaaaggttcgcatttttacagtggacgagtatgagcaattcgtcaaggacaattacagcagaacccggtccaaaatgaagaaacttctgatggatgacatccccgaagagtttgtgacacgccagctcaacgatagcagatatatttctaaggttgtgaaatccctgctgagcaatatcgtccgggaaaagggggaggaagaggccatctctaagaacgtgattccgtgcacgggaggcgtgaccgacagacttaaaaaggattgggggatcaacgaggtctggaataaaattatcctgcctcgcttccagcggctcaacgaactgacaggcaccaataagtttacaaccaaaaacgttgggattcaagagatccccacgatgcccctcgaactgcagaagggcttcaataagaaaagaatcgaccaccgccatcacgctatggatgccattatcattgcttgtgccaaccggaatatcattaactaccttaataacgagtccgcgaccgccaaggctgaactgagcagatacgacctccagaaaatgctgtgcgataaggccaaaacagacaataacgggaattataagtgggtgatccgcaaaccttgggcttctttcacccaggatacatacctggcccttgagaacatcattgtgagctttaagcaaaatctgcgggtcatcaacaaggcgaccaacagattcctccattataatgaggaaggaaagaagatttttgtgaaacagggcaagggggacaactgggccatccgcaaatccatgcacaaggacacggttttcggagaggtgaatctgcggagaattaagacagtcgctctcaacgaagccatgaaaaatccgcagagcatcgtggttaaggattttaaacggaagctgcttgagctgtggaacctcggcttcgacgctaaacgcattaagaagtactttgaagataatagagagacctggtctgacatcaacctgtccaaaatcgaggtgtattacttcagcaaggatacaaaagaccggtttttcgccacccgcaagcccctggatacctcctttgacagaaagaagattgaaaataacatcacagatacggggattcagaagatccttctgcggcacctcgagctgaaagacaataaccctgatattgccttctctcccgacggcatcgatgaaatgaatagaaacatcattcaactcaataacggaaagtatcatcagcctatcattaaaatccgctggtacgagcaggctgacaagttcgcggtcggccagaccgggaataaatttagcaagttcgtggaggccgctaaaggaacaaacctgtttttcgccgtttacgaatccaacattcttgacaagaagaccaatacaatcatcaaaaagcggaactatgccaccattcccctgaatgtggctatcgagagacaaaaacagggcctgcctgtcgcccccgaagatgagaacgggaatgacccgatttttgtgctctctcctaacgatctggtgtaccttcccacggacgatgaactggcgaatggaatcattgctcagcctctcgaccgcggccggatctataagatggtcagctgtacagggaacgagggccacttcattcccgccagaatcgccaatccgatcctgcaaaccattgagctcggatccaacaataaagctcagaaggcctggaccgatgaaatgatcaaggagatttgcatgcctatcaaagttgaccgcctgggcaacgtgcttgaatctagctccagctacaagaaatga

SEQ ID NO: 4581 - RNA, 4521 nt, synthetic construct
  misc_feature 1..4521: note = Cas9 variant
  source 1..4521: mol_type = other RNA
atgaagaccatcctgggcctcgacctggggcccaacagcattggatgggccaaagtggaggtcgatgacgaaggcaattaccttagaaacatcaagctggggtcccggattatccctatgacacaggatatgctcggagacttcgataaaggcgttaaggtgtctcaaacggctattcgcaccgactttagagggaatcggcgcctgatcgagagacaccttctgcggcgcgaaagactccatcgggtgctgcacgccctgaaattcctcccgaagcattatgaggatgcgatcggatgggaccgcaacgaacccgctacatacggcaagtttgtcaataacagcgagcctaaactggcctgggagagacaggaagatggctccatgcggttcctttttatggagtctttcaatgaaatggtggccgactttgctcagaaccagcccagcctggtttccgatgggaagaaaattcctctcgactggaccatctattacctgcgcaagaaagcccttacaagacccattaagaaggaggagctggcttggatcctcctgaatttcaaccaaaaacggggatattaccagctgcgcggcgaagaggaagaggataatctcaccaagagaaaagaatattacaagctgaaagtggtcggggtggaggccgacggagcgcctaagggcgggaaaacatggtacaacattcaccttgagaatggatggaccgcccggtgccagtctaagatcccgctggacgattgggttggcaaggtgaaagaatatattgtcacgaccgagtacgaagacgatggcaagacacccaaatgtgacaaggaggggaaagtgaagcgcagctttaagtcccctgaaaaagatgactggcagctcatcaagacccgcacagagaaattcatcgatgacagcaacaagaccgtgggagcttttatttatgattacctgcttgagaaacccttcgacaagatccggggcaagtatattagaacgatcgaacgcaaatactataagaatgagctgcgggaaattctcagagagcaaacaaaataccatgaagggctgcactctctggaggccctcaagatctgcgctgaggaactgtacaaaaacaaccagcagcaccaggagtatcttctgaagaaggatatgacctttctcctgcttaatgacctgatcttctaccaacgccctctcaaatccaagaaaagcctgattgccgactgtccctatgaagtctacaagtatgatgacaaactgacaggaaagaaaggccagaagaagatcaaatgcattgcgaagtctaacccgtactatcaggagttccggctctggcaatttatcgccaatctgagacttttctccgttaccgatgggaaagaggtgaccgctgaatacctgaagacagaggaagactacgtgcgcctctttagcttcctgaacgatcggaaagacattaagcaggagacgtttctgagatctttccttaagctcaaaaaggaatccatcggaagcgagaaaatctatcctattcgctggaattacatcgaggatgccaacaagtcctatccctgtaatgctacccggcatgaactgctgctcgcctttgacagagccgatattcctcgggagctgcttgacgtcgaagagagagaatacagactgtggcacctcctgtattctatcgaggctaaagaggaaacagagagcgcgctgcggaaacttaaggccaacaaggctttcggcgatctcaatattgacgatgcctttgtgaactccttcctgaagatcaaaccctttgaaaaggagtacggcgcctatagcgaaaaagctattaagaagctgctcgccgttatgagacgcgggtctctgtggaaagaggcggacatctgcgaggctaccaagcagaatatcgccaaaattcttcagaacgacatcgatgaaaagctgaaaaagaaaattgaggccgctgtgtccagcttcaataagctctctgactttcaaggactgcccacatggctggcctgttacgtcgtgtacggccggcatagcgaagctgcccagatccagtgctggcagtcccctgaggatcttaagacctatattaacaaattcaagcaacactctctcagaaatccgatcgttgagcagtgtctgctggaaacgctccgcacagtgtacgacatctggaaagatgcggggcagattgacgagatccacattgaactgggaagaaacatgaaaagcaccgccgagcagcgggctcgcaagaccaaggatatccttagaaacgaaaatacaaacctgcggattaagaatctcctggtcgagctgaaaaacgacgataagatcgagaatgtgcgcccctattcccctagccaacaggaaatccttagaatttacgaggaaggcgccctccaggagctgtctaaagaagacgagatgttcgaggatatctccaagattagcaaaatggctcagccctctcctaccgaactgtcccggtataagctctggctggagcaaaagtaccgcagcccctatacagggagagtcatcccgctttccaaactgtttacgaccgcctaccagattgaacatatcatccctcagtctcggtacttcgacgatagctttaacaataaggtgatttgcgagtccgaagttaactctctcaaagacaatatgctgggctatgagttcatcaaggagtgtggaggccgcattgtgcactgcacactgcttggggacgtcaaaatctttaccaaggaagagtacaaggatttcgtgacaaaacattatattgacaacacctacaagagagataaactgctcctggaagacatcccccaagagtttagcgcgcggcagctcaatgattccagatatattagcaagatggttcagacggtgctgtctaacatcgtccgcgccgagaatgaacaggaggctacctccaaattcgtggtgagctgcaacggagccatcacaaatcggcttaagaaggactggggcctgaacgatgtttggtcttccattgtctgtcctagatttaaacgcctcaacgaaatcaccaagacaaatgctttcgggcactgggaggacaaagccggaaagcatgtgtttcaaaccacggtgcccctggaactgcagcggggcttcagcaaaaagagaattgatcaccgccaccatgccatggacgctcttgtcatcgcgtgcgcctctcggaacattgtgaattacctgaacaatgagagcgctaactcccctgagaaaagagaagatctccgcaagaagctgtgtgacgagaaacggaagatcagaaaaccctggaagacatttacccaggacgcccgggaagccctcagcgatgttgtggtctctttcaaaaattatgtgcgcgttatcaacaaggctacaaattactacgagcactattccagctccgggaacaaggtgatgatttctcagaaaggcaatgacatgtgggccatcagaaagccgctgcataaagaaagcgtcttcggacgggtgaacctttgccgcaaggttattgtgtccctgaaaaaggcgctcgagaatatccctgctatttgtgataagaccctgagagactacatcaacgccctggtcgagaaacactttaatacccggcaacttctggcccacttcaagtctatcaactatagactcaaccgccagtgcgtggaaaaagtggaggtctggcagtttagcgatgaaaagattgagatggttgctcggagaaaatccctggacacatctttcgatgacaagcagatcagctccattacggataccggcatccaaaagattctcctgaattaccttcagacaaaagacgggaacgccgaaatcgcgtttacccccgagggaattgaggaaatgaataagaacatcagcctgtataatgatggcaaagctcatcagcccatcctgaaggtgcgcgtggccacacctaaagggatgaagtacccggtcggacaaaccggcaacaaagccacgaagttcgtggttgctgagaaggggacaaatctctattttgccatttacgaaaacgagctgggcgtgcggtcttacgacaccatcccccttaatattgtcgtggagagactgaaagaaggactctcccctgttccccaggctaacgaggccgatatccctctgaagttctatctcagccccaatgacctggtgtacgtccctaccaaagaaaacgaggacgaactttgtcgcgatcggatttataagtttgtggactcttccggcacaaccgcgaatttcgttccccacacaagcgccaacacgatctacaatgtggataaagagtatgctgagaagtgctgtaacggggccgtctttctgaatgaatacggactgggctctccgcagtccaagaaccagagagctctcaccggggagatgatcaaagaaatttgctggaagctgaaagtggaccgccttggaaacatcattaaggtgatcaaatga

SEQ ID NO: 4582 - RNA, 4530 nt, synthetic construct
  misc_feature 1..4530: note = Cas9 variant
  source 1..4530: mol_type = other RNA
atgaagaacatcgtgggcctggacctcgggaccaatagcattggatgggccgtcgttaacggctccgtgaatgatgacgggtctgagcagctggtgaaaatccaagctagcggatccagaattatccccatggatgccgcgatgattggcgacttcaacaagggaaattctatcagccagacagctgaacggacgcgccttagaggggtccggcgcctgtccgagagatacctcctgcggcgcgaaagacttcaccggatcctggatattctcggctttctgcctttccattttgcccaggacctggatcgccacggcaaaatcgtgaaggggaaagagccgaagctcgcctggagaaagaacgaagctggacagttcgagtttattttccaagactcttttaaagagatgctggaagatttcaaacttaatcatcccaacctgatcaccgacgataaaaaggttccttatgactggacaatttactatctccggaaaaagggcctgaccagcaagatctccaaagaggaacttgcctggattctgctcaattttaaccagaagcgcgggtactatcagctgagaggagaggaggaaaagaagaatgataacgtgatgatcatcaatagcaaagtcattgacgtggttaaggctgagaaagacaagaagtacgaaaaatattggtacaacgtgctgctcgagaatggcctgctttaccgggccgcgttctataacgatatctctttttggaaggggcacacaaaagagttcgtcctgaagaccattaaactcaagtccggaggcacaaagcaggaactgagctttcttccctctttcgacgagatcgagaaaatggaaaagaaacaaaaggataaaatgtacttcaagattaagctgaaaaccgaagccgacatcgatcaggctcataagacggtgggcacctatatctacgacacactcctggggaacccttcccagaaaattcgcggaagactggtgcggaccatcgagagaaagtattacaaagaggaactcaagctgattcttgataagcagaaagagtttcaccccgaactgcaagaccgcgccctctatgctgcctgcatcgaggaactgtaccctattaatgaggcgcaccggaacaatgtcggcaacagagatttcacatacctttttctggaagacatcctcttctatcagcgcccgcttaagagcaaaaagtctctgatcgataattgtccctacgaggagaaccaggggctcgacaaagaaaccggagagattaagtcctttcctgttaaatgcatcgccaagagccatcccctgttccaagaatttcggctttggcagttcattgtgaatctgagaatctatcgcaaggacctcgctcaggatgtggacgtcacgaacgagctgctgaaaacagaggaagattacgtggccctttttgactggctcaatggcaagaaagagattgatcagaaggctttcctgaaatatcctgtttttgggctgaagaaggaaatcgagaactaccggtggaattatgtgcaagacaaaccctacccgtgtaacgaaaccagactcctgatgcttgcccgcctggagaagtgcgatatttccatcgagttcctcacaaaagaaaatgaggaagccctgtggcacatcctgtactctgtcgaggacaagaacgaaattgtgaaagctctgcagaagtttgcggataagcatgacctcaatgccagcttcgttgatgtgttccggaaatttcctcccttcaagaaagagtatggatcctacagcgctaaggccatcaaaaagctgctgcctctcatgagaatgggcaagtattggtctgaggactccattgataaaggcacccgcaagcggatggacaaaatcattaccggggaatacgacgagaagatcgaaaacagagtccgggagaaagtgatccacctggccgatgtcagcgactttcgcggacttcccctgtggctcgtgtgttatattgtttacggcagacactctgaagctaaggagatcacacagtggaaaagccccgccgatattgactcctatctgaagtctttcaagcagcatagcctgcggaaccctatcgtggagcaaattatcatcgaaacgcttagagtcgtgcgcgatatttggaaacaggttgggaatatcgacgagattcacgtggaactcggacgggagatgaagaacccggcggataaaagaaagaaaatgacccagcagatgtccgagaatgaaaacacaaatctgcgcatcaagtacctgctcaccgagtttctgaaccccgaatacgaggtcgaaaatgtgagaccttatagcccctctcaacaggacattcttcggatctacgaggagggcgtgctgaactccgttagcgatctccctgaagagatctctgacattctgaagaaattcacagaaaccgatctgaagaaacgcccctccagaagcgagatccttcggtataagctctggctggaacagaaataccgctccccgtatacgggggaggtcattcctctgggcaagctctttacacccgcttacgagatcgaacatgtgattcctcagtcttgctatttcgacgatagcttttccaataaggtgatctgtgaggccgaagtcaacaaactgaagtctaatcttctgggacacgagttcattgtgaaacatcacggcgaaatcgttgagctcccctttgggaagaaagtgagaatcttcaccgtcgacgagtacgaacaatttgtgaaggacaactacagccggacccgcggaaagatgaaaaagctgctgatggatgacattcctgaggagttcgttgccagacagcttaatgattcccggtatatcagcaaagtggtcaagtctctgctctccaacattgtgcgcgaaaaaggcgaggaagaggctatcagcaagaatgttattccctgcacagggggagtgaccgacagactgaagaaagattggggcatcaacgaagtctggaacaagatcattctcccgcggttccagagactgaatgagcttacagggacgaacaaatttaccacaaagaatgtgggcatccaagaaattcctaccatgcccctggagctccagaaaggattcaacaagaaacgcatcgaccaccggcatcacgccatggatgctattatcatcgcctgtgcgaatagaaacattatcaattacctgaacaatgagtctgccacagctaaggccgaactgtcccgctatgaccttcagaagctgctctgcgataaagctaagaccgacaacaatggcaactacaaatgggtgattcggaagccctgggccagctttacgcaggatacctatctggcgctcgagaatatcattgtctctttcaaacaaaacctgagagttatcaataaggccacaaaccgctttcttcattacaacgaagaggggaagaaaattttcgtgaagcagggaaaaggcgacaattgggctatcagaaagagcatgcacaaagacaccgtgtttggggaagtcaacctgcggcgcatcaagacagtggccctcaatgaggctatgaagaaccctcagtccattgttgtgaaagatttcaagcggaaactgctggagctttggaatctgggatttgacgccaagagaatcaaaaagtatttcgaagataaccgggagacctggagcgacattaatctctctaagatcgaagtctactacttttccaaagatacgaaggaccgcttcttcgccacaagaaaaccgctggataccagctttgaccggaagaaaattgagaacaatatcacagataccggcatccagaagattctcctgcgccaccttgaactgaaagacaacaatcccgatatcgctttctcccctgacgggattgatgagatgaacagaaatatcattcaactgaacaatggcaagtatcatcagcccatcatcaagattcggtggtacgagcaggcggacaaatttgccgtgggacagaccggcaacaagttctctaaatttgttgaagctgccaaggggacaaatctcttctttgccgtgtatgagagcaacatcctggacaaaaagacgaacaccattatcaagaaaagaaattacgctacaattcctcttaacgtcgccatcgaacgccaaaagcagggactgcccgtggcgcctgaggatgagaatggcaacgaccccattttcgttctctccccgaatgatctggtgtatctccctaccgacgatgaactggctaacgggatcatcgcccagccccttgaccggggaagaatttacaaaatggtctcttgtacaggcaatgaggggcactttatccctgcccgcattgctaaccccatcctgcaaaccattgaactgggcagcaataacaaggcccagaaagcgtggacggatgagatgatcaaggaaatctgcatgccgattaaggtggaccggctcggaaatgtgctggagtcctctagctcctataaaaagtga

SEQ ID NO: 4583 - RNA, 4530 nt, synthetic construct
  misc_feature 1..4530: note = Cas9 variant
  source 1..4530: mol_type = other RNA
atgaagagaatcctgggcctcgacctggggaccaacagcattggatggtcccttatcgagcacgatttcaaaaataagcagggccagattgaagggctgggagtgcggatcattcccatgtctcaggagatcctcggcaaatttgacgccgggcagagcatctcccagacagctgatcgcacgaagtacagaggagtccggcgcctgtatcaaagagacaaccttcggcgcgaaagactgcatcgggttctcaaaattctggatttcctgcctaagcactactctgagagcatcgactttcaggataaggtgggccagttcaaaccgaagcaggaagtgaaactcaattatcgcaagaacgagaaaaataagcatgagtttgtcttcatgaactcctttattgaaatggtgtctgagttcaagaatgcccaacccgaactgttttacaacaaaggcaatggggaggagaccaagatcccttatgactggacactttactatctgagaaagaaggcgctcacccagcagattacaaaagaggagctggcttggcttatcctgaacttcaatcagaagcggggatactaccaactccgcggcgaagatattgacgaggataaaaacaagaagtatatgcagctgaaagttaataacctgatcgacagcggggccaaggtgaaaggaaaggtcctctacaatgtgatctttgataacggctggaaatatgaaaagcagattgttaacaaggacgagtgggaggggagaaccaaagaatttatcattacaaccaagacgctgaaaaatggaaacatcaagcggacctacaaagccgtggactccgagattgattgggctgccatcaaggctaagacagaacaagacatcaataaagccaacaagaccgtcggcgagtatatttacgaaagccttctggataatccctctcagaaaatccgcggcaagctcgtgaaaacaattgagagaaagttctataaggaggaatttgagaaactgctttccaagcagatcgaactgcagcctgaactcttcaacgaaagcctgtacaaagcgtgcattaaggagctgtacccccggaatgagaaccaccaatctaataacaaaaagcaggggttcgaatatctcttcaccgaggacatcatcttttaccagagacctctgaaatcccaaaagagcaatatttctggatgtcagttcgaacataagatctataaacagaagaacaaaaagacgggcaaacttgagctgattaaggagccgatcaagacaatttcccgcagccaccccctctttcaggagttccggatctggcagtggctgcaaaatcttaaaatttacaacaaggagaaaatcgaaaatgggaagctggaggatgtgaccacacagctcctgcctaacaacgaagcctatgtcaccctgtttgacttcctcaataccaaaaaggagctggagcagaagcagtttatcgaatacttcgttaaaaagaaacttattgataagaaagagaaggaacactttagatggaacttcgtggaggacaagaaatatcccttttccgaaacacgcgctcaattcctgtctcggctcgccaaggtgaaaggaatcaagaatacggaggatttcctgaacaaaaatacccaggtcggcagcaaggagaactccccttttattaaaagaatcgaacagctgtggcatattatctacagcgtgtctgaccttaaggagtacgaaaaggctctcgagaaattcgccgaaaagcacaatctggagaaagattcctttctgaagaacttcaaaaagtttcccccgttcgttagcgactatgcgtcttacagcaagaaagccatctccaagctcctgcctattatgcgcatggggaaatattggtctgagagcgctgtgcccacacaagtcaaggaacggtcccttagcatcatggagagagtgaaagttctgcctctcaaggaaggatactctgacaaggatctggccgacctgctttcccgcgtgagcgatgacgatattcccaaacagctcatcaagtcttttatttccttcaaagacaagaatcccctgaaaggcctgaacacctatcaggctaattacctcgtctatggccggcatagcgagacaggggatatccagcactggaagacccctgaggacatcgatagatacctgaacaattttaagcaacactcccttcgcaacccgattgtggaacaggtcgtgatggagacgctgcgggttgtgagagacatctgggaacattacggaaataacgagaaagatttctttaaggaaattcacgtcgagctcggccgggagatgaaatctcccgccgggaagcgcgaaaaactgagccagagaaacacagagaatgaaaacaccaatcatcggatcagagaggtgctgaaggaacttatgaacgacgcctccgttgagggaggcgtgcgcgattattctcctagccagcaagagattctcaagctgtacgaagaggggatctatcagaatcccaacaccaattacctgaaagtcgacgaagacgagatcctcaagattcggaaaaagaacaatcctacacagaaagaaatccagagatataagctgtggcttgagcaaggctacatttccccctataccggaaaaatcattccgctgacaaaactcttcacgcacgagtaccagatcgaacatattatccctcagagccgctactatgataactctctgggcaataagatcatttgcgagtccgaagtgaacgaggacaaagataataagaccgcttacgagtatctgaaagtggaaaaggggagcatcgtttttggacacaaacttctcaacctggacgagtacgaagcgcacgtcaataagtatttcaagaaaaacaagacaaaactgaagaacctcctgtctgaggatattcccgaaggcttcatcaatagacaacttaacgactcccggtacattagcaaactggtgaaggggctcctgtctaatatcgtgcgcgagaacggagagcaggaagccaccagcaagaatctgatccctgtcacaggcgtggttacctccaaacttaagcaggattgggggctgaacgacaaatggaatgagattatcgctcccagatttaagcggctcaacaaactgacgaatagcaacgatttcggcttttgggacaatgatattaacgccttccgcatccaggtgcctgactctctcattaagggattttccaagaaaagaatcgatcatcggcaccatgccctggacgctcttgtcgtggcctgtaccagccgcaatcacacacactatctgtccgcgctcaacgctgaaaataagaactactctctgagagacaaactggttatcaagaatgagaacggcgattacaccaaaacattccaaattccctggcaggggtttaccatcgaagccaagaacaatcttgagaaaacggtggtcagcttcaagaagaacctgcgggtgattaataaaacaaacaataagttttggtcctataaagacgagaacggaaatctcaacctgggcaaggatgggaaaccgaagaagaaactccgcaagcagaccaaaggatacaattgggccatcagaaagcctctgcataaagaaacagtttctggcatttataacatcaatgctcccaagaacaagattgccaccagcgtgcggacccttctgacagagatcaaaaatgaaaagcacctcgctaaaatcacggacctgcgcattagagagaccatcctgcccaaccatcttaagcactacctgaataacaaaggggaagccaacttctccgaggcgttttctcagggcggaattgaggatctcaataagaagatcacaaccctgaacgaaggcaaaaagcatcaacctatttatcgggtcaaaatcttcgaggtggggagcaagttctccatcagcgaagacgaaaattctgccaaatccaagaaatacgtggaggctgccaagggaacaaacctctttttcgctatttatctggatgaagagaataagaaaagaaactacgaaaccatcccgcttaatgaggtcattacgcaccagaagcaggttgccggctttcccaaaagcgaacgcctgtctgtgcagcctgactcccaaaaggggacattcctgtttaccctcagccccaacgatctggtgtacgtccctaataacgaggagcttgaaaatcgggacctgttcaacctcggaaatctgaacgtggagcagatctctagaatttataaatttaccgattccagcgacaagacatgcaatttcatcccctttcaggtttccaagctcatcttcaacctgaaaaagaaagaacagaagaaacttgacgtggattttattatccaaaacgagttcggcctggggagccctcagtctaagaatcaaaagagcattgacgatgtcatgatcaaagaaaagtgtattaaactgaagatcgaccgcctcggcaacatttccaaagcgtga

SEQ ID NO: 4584 - RNA, 4530 nt, synthetic construct
  misc_feature 1..4530: note = Cas9 variant
  source 1..4530: mol_type = other RNA
atgaagaccatcctgggcctcgacctggggacaaacagcgtgggatgggccgtcattaattccgttatcaaagagcaggctgaaagaatttggatcgagatggccggctctcggattatccccatggatgcggctgtgcttggggacttcgataagggaaacagcatctcccaaacgtctgaacgcaccagactgcggggcgtgcgcagactccgggagcgccagctgcttagacgggaacgcctgcacaaagtcctcaatattctggggtttctgcctaaccattacctcgagtatatcgacttcgagaagcacccgggaaaatttctgagcgatgccgaacccaaacttccttgggtgaaggacgagcagggcaaatacacattcctgtttcaggccgctttcgatgaaatgctcgccgactttgctattcatcaaccctccctggtttctggcgataagaaaatcccttatgactggaccatttactatcttagaaagaaagccctgacagagatgatcagcaaggaggaactcgcgtggattctgctgaatttcaaccagaagcgggggtactatcagctccgcggagaggaagaggaagataatgccggcaaatccgtggagttttacgctctgaaggtccttaccgtggaggccacagacgaaaagaaggggagagatgtttggtacaacgtgcacctggagaatggatggatctatcggcgctctagctccgtccccctcgactgggaaggccagatcaaagagttcattgtgaccacggacctgaaccctgatagcaccccgaaacttgacaaatacggggaagtgaagagatcttttcgggctcccaaggaggatgactggatgctgatcaaaaagagaacagaggccgatattgcgaatacccataaaacagtcggagcctatatctacgacaccctcctgcaaaagcctcagcagaaaattatcggcaagctggttaagacggtggaacgcaaactctatcgggatgagctgtcccttatcctgcagaagcaatgcgctttccacgccgaactccaggacagaacactgtacgctcgctgtgtggaggccctttatcccaacaatgaagtccagcggagaaacattgccaatcgcgattttgtgtacctgctcatggacgatgttctgttctaccaacggcctctgaaaaccaagaaaagcctcatcgctaactgcccctatgaggagaacgaatacgtggacagagagacaggcgaaattaagaaggcgccgctgaaatgtatcgccaagtctcaccctcttttccaggagtttcgcctgtggaatttcctctccaacattcggatctatcagaaagagaaggaaatcaatgggaccctgcatctggacgtcgatgtgaccgctgagtttcttaaaacagaagacgattacgttgccctcttcgactggctgaacagcagaaaggagattgaacagaagacgtttctgaaatatcccaagttcggactcaaaaaggagatctccaattaccgctggaactatgtggaggataaacaatacccttgcaatgaaacccggcacgccattctgtctagacttgagaaggctaacgtctgtatcgactttctgagcaatgaaaaagaggtggccctctggcatattctgtactccgtcagcgataagcaggaaatcgagaaggcgctgcggacattcgctgccaaaaacggccttgacgagtcttttgtggaagccttcaagaaatttcctcccttcaagtccgagtatggggcttacagcgccaaagctattaagaagctcctgcccctgatgcgctgcggaaaatattgggatgtttctagcatcgacgataccacaaaggaaagaatcaaaaagattgtggccggcgagtacgacgaacggatcgcggtcaaagtgagagataaggttatgaatctctccgacatttcttgttttaagcgcctgccgctttggctggcctgctatatcgtgtacaaccggcacagcgaggacaaagaggctgtcaagtgggaatcccccgccgatattgacgcttatctcgccagcttcaaacagcactctctgagaaatcctatcgtggaacaggtgatcaccgaaacgctgcgcgttgtcagagatatttggaagcaagtggggcggatcgacgagattcatatcgagcttggacgcgaaatgaaaaaccccgcggataagagaaagcggatgacagcccagattctcgagaatgaaaacgctaacctgcgcatcaaagccctgctcgctgagttcatgaatcctgaatacgagatcgagaacgtgagaccctactccccgagccagcaggaaattctgcggatctatgaggacatggtccttcacgccgaagatcaactgcctgaggaaattgacgccatcctcaagaaatttaattcttccaaggtgcccaccaaaagcgagttcctgcgctacaagctgtggcttgagcagaaatatagatccccttacaccggcgaactcattcccctgggcaagctgtttacagctgcgtatgagatcgaacatgttatccctcagtctcggtacttcgatgacagcttttccaacaaggtgatttgtgagtctgccgtcaataaactcaaggataaccagctggggtatgagttcatcaaaaatcaccatggacaaaaggtggaggttggctttgggaaaagcgtggagattttctccgtcgacagctacgaacgctttgtgaaggagcagtacgctaagtctgccgttaaaatgaagaaaatgcttatggatgacatccccgaacagttcattgagagacaactgaacgactcccggtatatcagcaaggtgattaaaggactcctgtctaatatcgtcagagagaagaacgattccggcgaatacgagccggaagccgtgagcaagaatatcgtggtctgcaccgggtctgttacagaccgcctgaaacgggattggggcatgaacgacgtgtggaatagcattgtgtatcctagatttgagcgccttaactccctgacggatacccagagcttcggacactgggaaaataagtctggcaaaaaggtctttcagacagagctccccctggagtaccagaaagggttctccaagaagcggatcgaccacagacatcacgctatggatgccattgtgatcgcgtgtgctacccgcaaccatgttaactatctcagcaatgaatccgcctctcggaacgccaaaattagcagatacgacctgcaacgccttctgtgcgataagtcccggacagacgataatggaaactataaatgggtgatcaagaaaccctgggacaccttcacgcaggacgctagagaggtcctctctaagatcgtggttagcctgaagcagaatctgcggattatcaacaaaaccacaaatgtgtaccgccaccttgatgccaccggcaacagagtctacgaaaagcagaaaacaggggactcctgggcgattcggaagcctatgcacaaagataccgtgtttggagctgttaatctgcgcaaggtgaaagtcgtgagactctctgtggccctggacgccccgacgatgatcgtcgataagcgggttaagaacaaagtgttcgagctcctgagctataagtacgacaaaaagagaattgaaaaatattttaaggagaatgctgtgctttggaaggagctggatctcgcccgcgtcgctgtgtactatttcacagaagccaccacagagcccctggttgcggtgcggaaacctctggactccacctttaacgaaaagaaaatcaaggagagcgtcaccgatacaggcatccaaaagattcttctgaatcatctctgcacgaaggaagggaagcccgacctggccttctctgctgagggcatcgaggaaatgaacagaaatctcctgcagcttaacaacggaaaacgccaccagcctatttacaaggtgcgggtttatgagcccagaggcaataaattttccgtgggggtcctgggaaacaagggcaccaaatgggtggaagccgctaaggggacaaatctgttctttgccatctacattaccgaggatggaaagcgcacatacgagaccatccctctcaacatggtcattgaacgggagaaacagggcctggcccccgtgccggacaagaatgaaaaaggggataaacttctgttctggctcagccctaacgacctggtttatctccccacggaggaggaactggagtttggcagaatcaatgaacctatcgaccgcggaagaatttacaagatggtgtcttccagcggcaaccaatgtttcttcatcccccagtctatttccaatgctatcattccgacaaaggagcttggggcgaacaataaagccgaacggagctgggatggagctatgatcaagaacatctgcattcctgtcaaggtggaccgcctgggcagaatcattgaggttaaatatcggatcaatgaatga

SEQ ID NO: 4585 - RNA, 4530 nt, synthetic construct
  misc_feature 1..4530: note = Cas9 variant
  source 1..4530: mol_type = other RNA
atgaagaccatcctgggcctcgacctggggacaaacagcgtgggatgggccgtcattaattccgttatcaaagagcaggctgaaagaatttggatcgagatggccggctctcggattatccccatggatgcggctgtgcttggggacttcgataagggaaacagcatctcccaaacgtctgaacgcaccagactgcggggcgcccgcagactccgggagcgccagctgcttagacgggaacgcctgcacaaagtgctcaatattctggggtttctgcctaaccattacctcgagtatatcgacttcgagaagcacccgggaaaatttctggccgatgctgaacccaaacttgcctgggtcaaggacgagcagggcaaatacacattcctgtttcaggctgccttcgatgaaatgctcgcggactttgccattcatcaacctagcctggtgtccggcgataagaaaatcccctatgactggaccatttactatcttagaaagaaagctctgacagagatgatctctaaggaggaactcgcctggattctgctgaatttcaaccagaagcgggggtactatcagctccgcggagaggaagaggaagataatgctggcaaaagcgttgagttttacgccctgaaggtgcttaccgtcgaggcgacagacgaaaagaaggggagagatgtgtggtacaacgttcacctggagaatggatggatctatcggcgctccagctctgtgcctctcgactgggaaggccaggtcaaagagttcatcgtgaccacggacctgaaccccgatgggacccctaaacttgacaaatacggagaagtgaagagatcctttcgggccccgaaggaggatgactggatgctgattaaaaagagaacagaggctgatatcgccaatacccataaaacagtcggcgcttatatttacgacaccctcctgcaaaagccccagcagaaaatcattggcaagctggttaagacggtggaacgcaaactctatcgggatgagctgagccttatcctgcagaagcaatgcgccttccacgccgaactccaggacagagctctgtacgcgcgctgtgtggaggccctttatccttctaacgaagtccggagaaagaatatcgctaaccgcgattttgtgtacctgctcatggacgatattctgttctaccagcggcccctgaagaccaaaaagtccctcatcgccaattgcccttatgaggagaacgaatacgttgacagagagacaggggaaattaagaaaacacccctgaagtgtatcgccaaaagccacccgcttttccaagagtttcgcctgtggaacttcctctctaatattcggatctatcagaaggagaaagaaatcaacggaaccctgcatctggacgtggatgtcaccgctgagtttcttaagacagaagacgattacgtggccctcttcgactggctcaattccagaaaggagattgaacagaaaacgtttctgaagtatcctaaattcggcctgaagaaagagatcagcaactaccgctggaattatgttgaggataagcagtacccctgcaacgaaacccggcacgcgattctgtcctctcttgagaaagctaatgtgtgtatcgactttctgagcaacgaaaaggaggtcgccctctggcatattctgtactccgtgagcgataagcaagaaatcgagaaagccctgagaacattcgctgccaagaatgggcttgacgagtcttttgtcgaggctttcaaaaagtttcctcccttcaaatccgagtatggagcctacagcgcgaaggccattaagaaaatgctccccctgatgcggtgcggcaagtattgggatgtgtctagcatcgacgataccacaaaagaacgcatcaagaaaattgttaccggggagtacgacgaaagaatctccgtgaaggtccgggataaggtgatgaacctgtctgacattagctgttttagacgcctccctctgtggcttgcttgctatatcgtttacaatcggcactccgaggacaaagaggccgtgaagtgggaaagcccggctgatattgacgcctatctggcgtctttcaaacagcactccctcagaaaccccatcgtcgaacaggtgatcacggaaacactgcgcgtggttagagatatttggaagcaggtcggacggatcgacgagattcatatcgagctgggccgcgaaatgaaaaatcctgccgataagagaaagcggatgaccgctcaaattcttgagaacgaaaatgccaacctccgcatcaaagctctgctggccgagttcatgaaccccgaatacgagatcgagaatgtgagaccttacagcccctctcagcaggaaattctccggatctatgaggacaccgtgctgcacgccgaagatcagcttccggaggaaattgacgctatcctgaagaaatttaactccagcaaggtccctacaaaatccgagttcctccgctacaagctgtggctggagcaaaaatatagatctccctacaccggcgaacttattcctctcgggaagctgtttacagcggcctatgagatcgaacatgtgatcccccagagccggtacttcgatgactccttttctaataaggttatttgtgagagcgctgtgaacaaactgaaggataatcagctcggatatgagttcatcaaaaaccaccatggccagaaggtcgaagtggggtttggaaaatccgttgagattttcagcgtggactcttacgaacgctttgtcaaggagcaatacgccaagtccgccgtgaaaatgaagaaactgcttatggatgacatccctgaacagttcattgagagacagctgaatgacagccggtatatctctaaggttattaaaggcctcctgtccaacatcgtgagagagaagaatgatagcggggaatacgagcccgaagctgtctctaagaacatcgtggtgtgcacgggcagcgtcaccgaccgcctgaaacgggattggggaatgaatgacgtttggaactccattgtgtatccgagatttgagcgccttaatagcctgacagatacccaatctttcggccactgggaaaacaagtccgggaaaaaggtgtttcagacagagctccctctggagtaccagaaaggattcagcaagaagcggatcgaccacagacatcacgccatggatgcgattgtcatcgcttgtgccacccgcaatcatgtgaactatctctccaacgaatctgccagccggaatgctaaaatttccagatacgacctgcagcgccttctgtgcgataagaaccggacggacgataatggcaactataaatgggttatcaagaaaccctgggacaccttcacacaagacgccagagaggtgctctctaagatcgtcgtgagcctgaagcagaatctgcggattatcaacaaaaccacaaatgtttaccgccaccttgatgcgaccgggaacagagtgtacgaaaagcagaaaacgggagactcctgggctattcggaagcccatgcacaaagatacagtctttggcgccgtgaatctgcgcaaggttaaagtggtcagactctctgtggccctggacacccctgctatgatcgtggataagcgggtcaagaacaaagttttcgagctcctgagctataagtacgacaaaaagagaattgaaaaatattttaaggagaatgccttcctttggaaggagctggatctcgctaaagtggccgtgtactattttacagaagcgaccaccgagccgctggtcgccgtgcgcaagcccctggactccacattcaacgagaaaaagatcaaagaaagcgttacggataccgggatccagaagattcttctgaatcatctctgcacaaaggaaggcaaacctgacctggctttttctgccgagggaatcgaggaaatgaaccggaatctcctgcaacttaacaacggcaagtcccaccagcccatttacaaagtgagagtctatgagcctcgcgggaataagttcagcgtgggagttctgggcaacaaagggaccaagtgggtggaagctgccaagggaacaaatctgtttttcgccatctacattaccgaggatggcaaacggacgtacgagacaatccccctcaacgtcgtgattgaaagagagaagcaggggctggtccctgtgcccgaccgcaataaaaagggcgataaacttctgttttggctctctccgaacgacctggtttatctccctaccgaagaggaacgggagttcggaagaatcaatgagcccatcgaccgcggcagaatttacaagatggtgtcctgtaccgggaacgaaggacatttcatccctgctaatgtcgcgaaccccattgtgccggttatcgagctgggcagcaataacaaagcccagcgggcttggacaaatgaaatgattaaggatatctgcatccctattaaggtggaccgccttgggcacatcattgaggtcaaatatagaatcgatgaatga

SEQ ID NO: 4586 - RNA, 4530 nt, synthetic construct
  misc_feature 1..4530: note = Cas9 variant
  source 1..4530: mol_type = other RNA
atgaagaaaatcctgggcctcgacctggggaccaacagcgtgggatgggccgtcattaattccgttgtgaacgatgagggcaaggaacagcttgtgaatatctctagctgcgggtccagaattatccccatggacgctgccacactgggagatttcgacaaaggcaactctaagagccctgtcgcggagcggacgcgcctcagaggggtgcggcgcctgcttgaaagatccctgctccggcgcgagagactgcaccgggttctgtctgtgatgggatttctcccggaacattacgctgcccaactggatcgctatggcaaattccttcccgagaccgagcctaagctggcctggtacaaggacgaaacaggcaaatatagatttctcttccaggatagctttaatgagatgctggaagacttccacgagcatcaccccgagcttgtcgctgaagggaagaaaattcattacgattggaccatctattacctgcggaagaaagccctctcccagaagatcacaaaggaggaactggcttggattctgctcaactttaatcagaaacgcggatattaccaactgagaggcgaggaagaacaggaggacaacaagaaaagcgtggaatactatgcccttaaggttgtggcggtcgaggattctggggaccggaaaggaaaggatatctggtacaatgtgaaactggaaaacggctgggtgtatcgcagagcctccggggtccctctcgactgggttggaaaggtgaaggagttcattgtgaccacagacctggatgaaaaaggcaatcccaagaaagacaaggatggcaacgtcaaacggagctttagagctcctaaggaggacgattgggggcttctgaagacccgcacgcaggcccagatcgacgagtctggacaaaccgtgggcacatacatttatgaatccctcctgcggatgccggatcagaaaatcagagggaagctggttcgcaccattgagcggaaatactataaggacgaactcagaaaaatcctgatcaagcagagcgagttccacacagcccttcaggatcacaatctgctcctggcttgtattgaagaactttaccccaacaatgaggcgcatcgccggctgctctctacctccgactttacgtacttcctggtggaagatatcctgttttatcaaagacctctcaagagccagaaaggacagattgacgactgcccctacgagtcccacgtctatcgcgataagaaagacggctctctgcaacatgtgcctcttaagtgtgttagcaaatcccaccccctgttccaggagttccggctctggcactttctgagcttcctgagaatctaccagcgcgagcggatgattgatgggtctcttaagctcgacgtggatgtcacaaacgagtttctgcagaacgaagacgattatgtgaagctgttcgactggctcaatgagagaaaagaaatcgatcaaaagaccatcctggcctacaaaccgtttggacttaagaaaaacgagcagtccaagtatcggtggaattacgtcgaagacaaaagctacccttgcaactctacacgcgctgatatgattttcagactgagcaaggccggcgtgcccgaggagtttctcacccgggaaaaggaggaagctctgtggcatatcctgtattccatttctgacaaaaaggagcttaccaaagccctcggcacattcgccgaaaagaatgggctgaacgagacgtttgttgagatcttcagcaaaatgcctccctttgaatccgattacgctgcgtatagcctgaaggccattagaaagctcctggctcttatgcgcatgggaaaatactgggacgagcaggccatcgacgaacacacccggtctagaatcgagaagattctgacaggcgaatatgatgagaccatccgcacaagagtgcgggagaaagccatgcatctcaccgacatttccagcttccgcgggctgcccctgtggcttgcttgttacgtcgtgtatgatagacactctgaagccaaggagctcgttaaatgggaaacgcctgacgatatcgaccattttctgcggaagttcaagcagcactccctgcgcaatccgattgtggagcaaatcattatggagacactcagaaccgtccgggatatctggaaacaggaaggaaagatcgacgagattcacgtggaactgggccgcgagatgaaaaaccccgcgaaggaaagagctcggatcaccgcccaggtgcttgagaatgagaacacaaatctgcgcattaaagccctcctggctgagttcatgaaccctgagtttgaaatcgagaatgttagaccctacagccctgcccagcaagaaattctgcggatctacgaggagggggtcctttccggcgtggctgaaaaggatctccccgacgatatcgcctctattctgaagaaattcagagagaacgacgtgaagaaacgcccgaccacaagcgaagtcctgcggtataagctctggctggagcagagataccgctccccttatacgggacggatcattccccttggcaaactgtttacccctgcgtacgaaatcgagcatgtgattccccagtctagatatttcgatgacagctttacaaataaggttatctgcgagtccgccgtgaacaaactcaaggacaactgtctggggtacgagttcgtcaagaaacacagcggagaaaaggtggaactgggcaatggggagaccgctacaatcttttctgttgaggaatatgagcgcttcgtgaaagattcctactttaacaatagcaagaaaattaagaaacttctgctcgaagacatccctgataacttcattgagcggcagctgaatgactctagatacatctccaaagtcgttaagagcctcctgtctaacattgtgtgcgaagagggagagcaagaaggcatgagcaaaaatgtgatcgtctgtaccgggggcgtgacggatcgccttaagaaagactggggagtgcaggatgtctggaaccggatcattctgcccagatttctccggctgaataagatgaccgaccgcacagatttcaccgccgtttccacaaacggccatctgcttccggctgtgcctctgcacctccagaaggggtttaataaaaagagaatcgaccaccggcatcacgccatggatgcgattgtgatcgcctgcgctggacgcaacattgtcaattatctgaacaatgccagcgctagaaaaggctctgagatctcccggtacgacctccaacatctgctttgtgacaaggtgaaaaccgatgccaacgggaactataagtggattctgagaaagccctgggaaacgttcacacaggacctctacgccgctctgaccaatatcgttgtgagcttcaaacagaacctgcgcgtcatcaatcggacaaccaaccactatcagcattacaatgaggatggagaaaagaaaatgattccccaaaccaagggcgacagacttgcgatccgcaaacctatgcacaaggatacagtgtatggggaggttaacctgcggaaggagaaaacgctcccgctgaaggacgtggtcaaaaatccctccgccgtggttgataagtctctcaaaaacaagctgtacgaacttctgaaaagccagtacgacctgaaggctattaccaagtattttgagacacaccaggatgtgtgggccgacgtcaatctcaaaaagatcaaagtgtactatttcaccaaggaaacaaacgagagatttttcgccacccgcaaatccctggattctagcttttcccagaagaagattgaagaggaggtgacggacacaggcatccaaaagatccttctgcggcatctccagcagaatggaaacaatcctgatattgctttctctcccgacggcgtcgaaagaatgaaccagaatatgaccatcctgaacgacgggaagtggcaccaacctatttacaaagttcgcacctatgagaaggccgataaatttgcggtgggagaaaagggcaacaaggtgaaaaagttcgtcgaggctgccaaagggacaaatctctttttcgccgtgtacgagagcatccaggaagacgaggctaccggaaagcaggttagaaaacggacatttgccacgattcccctgaacgaagtgatcaagcgcaagaaacaaggccttcctgcggctcccgaggattccaaggggaatctgccgatcttcgtcctgagccctaacgacctcgtgtatctgcccaccgaagaggagagaaattctggcaaaattatccagcctcttgatcgggaacgcatttacaagatggtttcctgcacagagggagaatgccattgtatccccgagtacgtggccaacccgattctgcagaccatcgaactcggcagcaataacaaagcccagagagcttggtctggggagatgattaaggagatctgcgtccctgtgaaagtcgaccggctgggaaatgtgtccctcatcaagatttga

SEQ ID NO: 4587 - RNA, 4530 nt, synthetic construct
  misc_feature 1..4530: note = Cas9 variant
  source 1..4530: mol_type = other RNA
atgaagaccatcctgggcctcgacctggggacaaacagcgtgggatgggccgtcattaattccgttatcaaagagcaggctgaaagaatttggatcgagacggccggctctcggattatccccatggatgcggctgtgcttggggacttcgataagggaaacagcatctcccaaacctctgaacgcacaagactgcggggcgcccgcagactccgggagcgccagctgcttagacgggaacgcctgcacaaagtgctcaatattctggggtttctgcctaaccattacctcgagtatatcgacttcgagaagcacccgggaaaatttctggccgatgctgaacccaaacttgcctgggtcaaggacgagcagggcaaatacaccttcctgtttcaggctgccttcgatgaaatgctcgcggactttgccattcatcaacctagcctggtgtccggcgataagaaaatcccctatgactggacaatttactatcttagaaagaaagctctgaccgagatgatctctaaggaggaactcgcctggattctgctgaatttcaaccagaagcgggggtactatcagctccgcggagaggaagaggaagataatgctggcaaaagcgttgagttttacgccctgaaggtgcttacagtcgaggcgaccgacgaaaagaaggggagagatgtgtggtacaacgttcacctggagaatggatggatctatcggcgctccagctctgtgcctctcgactgggaaggccaggtcaaagagttcatcgtgacgaccgacctgaaccccgatgggacacctaaacttgacaaatacggagaagtgaagagatcctttcgggccccgaaggaggatgactggatgctgattaaaaagagaaccgaggctgatatcgccaatacacataaaaccgtcggcgcttatatttacgacacgctcctgcaaaagccccagcagaaaatcattggcaagctggttaagacagtggaacgcaaactctatcgggatgagctgagccttatcctgcagaagcaatgcgccttccacgccgaactccaggacagagctctgtacgcgcgctgtgtggaggccctttatccttctaacgaagtccggagaaagaatatcgctaaccgcgattttgtgtacctgctcatggacgatattctgttctaccagcggcccctgaagaccaaaaagtccctcatcgccaattgcccttatgaggagaacgaatacgttgacagagagacaggggaaattaagaaagcgcccctgaagtgtatcgctaaaagccacccgcttttccaagagtttcgcctgtggaacttcctctctaatattcggatctatcagaaggagaaagaaatcaacggaaccctgcatctggacgtggatgtcaccgccgagtttcttaagacagaagacgattacgtggccctcttcgactggctcaattccagaaaggagattgaacagaaaacgtttctgaagtatcctaaattcggcctgaagaaagagatcagcaactaccgctggaattatgttgaggataagcagtacccctgcaacgaaacccggcacgctattctgtcctctcttgagaaagccaatgtgtgtatcgactttctgagcaacgaaaaggaggtcgccctctggcatattctgtactccgtgagcgataagcaagaaatcgagaaagctctgagaacattcgccgctaagaatgggcttgacgagtcttttgtcgaagccttcaaaaagtttcctcccttcaaatccgagtatggagcgtacagcgccaaggctattaagaaaatgctccccctgatgcggtgcggcaagtattgggatgtgtctagcatcgacgataccacaaaagaacgcatcaagaaaattgttaccggggagtacgacgaaagaatcgccgtgaaggtccgggataaggtgatgaacctgtccgacatttcttgttttagacgcctccctctgtggcttgcttgctatatcgtttacaatcggcacagcgaggacaaagaggccgtgaagtgggaatccccggcggatattgacgcctatctggctagcttcaaacagcactctctcagaaaccccatcgtcgaacaggtgatcacggaaacactgcgcgtggttagagatatttggaagcaggtcggacggatcgacgagattcatatcgagctgggccgcgaaatgaaaaatcctgccgataagagaaagcggatgaccgctcaaattcttgagaacgaaaatgccaacctccgcatcaaagccctgctggctgagttcatgaaccccgaatacgagatcgagaatgtgagaccttactcccccagccagcaggaaattctccggatctatgaggacaccgtgctgcacgcggaagatcagcttccggaggaaattgacgccatcctgaagaaatttaactcttccaaggtccctacaaaaagcgagttcctccgctacaagctgtggctggagcaaaaatatagatccccctacaccggcgaacttattcctctcgggaagctgtttacagctgcctatgagatcgaacatgtgatcccccagtctcggtacttcgatgacagcttttccaataaggttatttgtgagtctgccgtgaacaaactgaaggataatcagctcggatatgagttcatcaaaaaccaccatggccagaaggtcgaggtggggtttggaaaaagcgttgagattttctccgtggacagctacgaacgctttgtcaaggagcaatacgctaagtctgccgtgaaaatgaagaaactgcttatggatgacatccctgaacagttcattgagagacagctgaatgactcccggtatatcagcaaggttattaaaggcctcctgtctaacatcgtgagagagaagaatgattccggggaatacgagcccgaagcggtcagcaagaacatcgtggtgtgcacgggctctgtcaccgaccgcctgaaacgggattggggaatgaatgacgtttggaacagcattgtgtatccgagatttgagcgccttaattccctgacagatacccagagcttcggccactgggaaaacaagtctgggaaaaaggtgtttcaaacagagctccctctggagtaccagaaaggattctccaagaagcggatcgaccacagacatcacgctatggatgccattgtcatcgcctgtgctacccgcaatcatgtgaactatctcagcaacgaatccgcctctcggaatgcgaaaattagcagatacgacctgcagcgccttctgtgcgataagaaccggacggacgataatggcaactataaatgggttatcaagaaaccctgggacaccttcacacaagacgctagagaggtgctctccaagatcgtcgtgtctctgaagcagaatctgcggattatcaacaaaaccacaaatgtttaccgccactttgatgccaccgtgaacagagtctacgaaaagcagaaaacgggggacagctgggccattcggaagcccatgcacaaagatacagtgttcggagctgttaatcttcgcaaggtgaaagtcgtgagactgtccgtggccctcgacacccctgctatgatcgtcgataagcgggttaagaacaaagtgtttgagctgctctcttataagtacgacaaaaagagaattgaaaaatatttcaaggagaatgcctttctgtggaaggagcttgatctggcgaaagtggccgtctactatttcacagaagctaccaccgagccgctcgtggccgttcgcaagcccctggacagcacatttaacgagaaaaagatcaaagaatccgtgacggataccggcatccagaagattctgcttaatcatctgtgcacaaaggaagggaaacctgacctcgctttcagcgccgagggcatcgaggaaatgaaccggaatctgctccaactgaacaacggaaagtctcaccagcccatttacaaagtcagagtgtatgagcctcgcggcaataagttttccgttggggtgcttggaaacaaaggcaccaagtgggtcgaagccgctaaggggacaaatctgttctttgcgatctacattaccgaggatggaaaacggacgtacgagacaatccccctgaacgtggtcattgaaagagagaagcagggcctcgtgcctgttcccgaccgcaatgaaaaaggggataagctgcttttctggctgagcccgaacgacctcgtgtatctgcctaccgaggaggaacgggagttcggcagaatcaatgaacccatcgaccgcggaagaatttacaaaatggtctcttgtaccggcaacgaggggcattttatccctgccaatgtggctaaccccattgttccggtgatcgaactcggatccaataacaaggcccagcgggcctggacaaatgagatgattaaagatatctgcatccctattaaggtcgaccgcctgggccacatcattgaagtgaagtatagaatcgatgagtga

SEQ ID NO: 4588 - RNA, 4530 nt, synthetic construct
  misc_feature 1..4530: note = Cas9 variant
  source 1..4530: mol_type = other RNA
atgaagaaaaccctgggcctcgacctggggacaaacagcatcggatgggccgtgattaattccaacatcgattctgagggcaaggaaaaacttgtcgggattagctcctgcggatctagaatcattcccatggacgctacgaccctgggcgatttcgggaagggaaatacaaaaagccctgttgccgagcggacccgcctcagaggcatccggcgcctgcttgaaagatccctgctccggcgcgagagactgcaccgggtgctgtctgtgatgggctttctcccggaacattacgcgagccagctggaccgctatgggaagttccttcccgagacagagcctaagctggcttggtacaaagatgactccggaagatatcaatttctcttccaaaagagctttcacgaaatgctggaggatttccggcagcatcagcccgaacttgtcgccggcgagaaaaagatcccttacgactggaccatttattacctgcgcaaaaaggccctctctcaggagatcacaaaggaggaactggcttggattctgctcaactttaatcagaaaagagggtattaccagctgcggggagaagaggaacaggaggagaacaataagtccgtggaataccacgcccttaaagttgtgagcgtcgaggattctggcgaacgcaaggggaaagacatctggtataacgtgaccctggagaatggatgggtttacagacgggcttccaacattcccctcgattggacgggcaaggtgaaagagttcgtcgtgaccacagaactggacgatgccggcaatcctaagaaggacaaagaggggaacgtgaagagatcctttcgcgcgccgaaagaagacgattggggacttctgaagacccggacacaagcccagatcgacgagtctggcaaaaccgtcgggacgtatatttacgaatccctcctgtgtatgcccaatcagaagatcagaggaaagctggttcgcacaatcgagcggaaatattacaaggatgaactcagacagattctggtgaaacaaagcgagttccatgctgcccttcaggaccacaacctgctcctgtcctgcatcgaggaactttatcctaataacgaggctcaccgccggctgctctctgccagctcctttatttacttcctgatcgaagatattctgttttaccagagacccctcaagagccaaaaaggcctgatcgacaactgtccttatgagtctcatatctacaaggataagaaagacgggtcccttcaccatgtgcccctgaagtgcgtcagcaaatctcaccccctcttccaggagttccgcctgtggcagtttctgagcaatcttcggatttatcagagagaacgcatgatggatggatccctcaagctggacgtggatgttacccgggagttcctgccttctgaagaggactacgtgaaactctttgactggctgaacgaaagaaaggagatcagccaaaagttccttctggcgtataaaccctttggcctcaagaaaaatgagcaggccaactaccggtggaattatgtcgaagataagtcctacccttgtaacgagacacgcgctgaaattaaaagcagactgtctaaggccggcgtgcccgaggagttcctgaccgaagagaaagaagaggctctttggcacatcctctactccattagcgacaagaaggaactgaccaaagccctggggacatttgccgctaagaattgcctcaacgagtctttcgttgaagtgtttgcgaaaatcccgcctttcgagtccaattatgccgcttacagcctgaaggccatccggaaacttctggccctcatgagaatgggaaagtattggaacgagcaggctattgatcgccagacgcgggacagaatcgaaaagattctgaccggcgagtacgatgaaacaatccgctccagagtccgggagaaagccatgctgcttaccgacatttctagctttcgcgggctcccgctgtggctggcgtgttatatcgtgtacgatagacattccgagtctaaggaactcgtcaaatgggagacacccgctgacattgatcacttcctgagcaagtttaaacaaaattcccttcggaaccctatcgtggaacaggttatcaccgagagcctgcgcacggtgagagacatttggaagcaggaaggaaagatcgatgagattcatgtcgagctcggccgggaaatgaaaaatcccgccaaggagcgcgccagaatcacagctcaggtgcaagaaaacgagaataccaacctgcggattaaagccctgcttgctgaatttatgaaccctgagttcgagatcgaaaatgttcacccctattctccggggcagcaggagatcctccgcatttacgaagacggcgtgctgtccggaatcgccgagaaggatctgcctgacgacattaccgcgatcctcaaaaagttcagagaaaacgatgtcaagaaacggcccacaaccagcgaggtgctgagatacaaactttggctggagcagcgctatcggtctccttacacaggcagagtgattcccctcgggaagctgttcacgcctgcctatgaaatcgagcatgttatcccccaatcccgctactttgacgatagcatttctaataaggtcatctgcgaaagcgctgtgaacaaactgaaggacaattgtcttggatatgagttcattaaaaagcactccggcgagatggtggaactggggaacggagagaccgtcccggtgtttagcgttgaagagtacgaacggttcgtgaaggagtcttattttggcaattccaaaaagatgaaaaagctcctgctcgaggatatccctgacagcttcattgaaagacagctgaacgattcccgctacatctctcgggtcgtgacaagccttctgtccaatctcgtttgcgaggaaggggagcaggacggcctgtctaaaaacgtgatcgtctgtaccggaggcattacagatagactgaagaaggactggggagtgcaagaagtttggaatcgcatcattcttccccggtttctgagactcaacgagatcaccgggcggacggatttcaccagcacatccgtgaatggccatctgctccccgccctgcctctttacctgcagaaagggtttaacaagaaacgcattgaccacagacaccatgctatggatgccatcgtcattgcgtgcgccaatcggaacatcgtgaactatctcaataactctagcgctcgcaagaatagcgagatcagcagatacgacctgcagcggctgctttgcgaaaaagtgaagaccgacgccaacggaaattataagtggattctgagaaaaccgtgggagacattcacccaggatgtctacgctgccctcacgaacatcgttgtgtcttttaagcaaaatctgcgcgtgattaaccggacaaccaattattaccagcactataacgaagccggcgagaaaagaatgatcccccagacaaagggggaccgctgggctattcggaaacctatgcacaaggataccgtctacggcgaagtgaatctcagaaaggagaaaaccctgccccttcgcgacgttgtgaagaacccttccatcgtcgtggataaaagcctgaagaataaactgtacgagctcctgaagtctcagtatgaccttaaggcgatcgccaaatacttcgaaacacatcaagatgtttgggctgacgtgaacctgaagaaaattaaggtctattacttcacgaaagagaccaatgaacggtttttcgccacaagaaagtccctcgatcccagctttgaccagaaaaagatcgaggaggaagtgaccgatacaggagttcagaagattctgctccaccatctgcagcaaaacaacaatgaccctgacatggccttctctcccgatggcatcgaccgcatgaaccagaatatgaccattcttaacgatgggaaatggcaccagccgatctataaggtgagaacgtacgagaaagctgacaagtttgccgtcggagaatccggcaataaagcgaagaagttcgtggaggctgccaaagggacaaacctgtttttcgccgtgtatgaaagcgtccaagaggatgaggctatcggaaagcaggtttgtaaacggacctttgccaccattcctctgaatgaagtgatcaagcgcaaaaagcagggcctccccgcggctcctgaggacctgaacgggaatcttcccaagttcgtgctgtccccgaacgatctcgtctacctgcctacagaagaggaaagaaatagctctcggattatccagcccctcgaccgcgagagaatttacaaaatggtgagctcctctggcagccaatgctttttcatcaaggttttcgtggccaactccatttgggataaaaatgagtattctagcctgaacaagatggaacgggccatcaccaatgagatgatcaaagaaatttgtgtccctatcaagattgacagacttggaaacgtgtccctgatccagatttga

SEQ ID NO: 4589 - RNA, 4533 nt, synthetic construct
  misc_feature 1..4533: note = Cas9 variant
  source 1..4533: mol_type = other RNA
atgaagagaatcctgggcctcgacctggggaccaacagcattggatgggcccttgtggattccgaggaacagcggatcctgggcatggggtctcgcattatccccatggaccaaggagtcctcgatacattcagcggcgggaatcctgttgagacgcagaccgctgccagaacagtgtaccggggaacccgcagactgcgggaacgcgcgcttctgagacgggagcgcctcattagagtgctgaacatgatgaaatttctgccggaacactatgcttcccagatcgacttcgagaagcggctcggccagtttttcgatgagaaagaacccaagctggcctggaaacaaaatgacgagggccgctttgaatttatctttcagcagtctttcaacgagatgattgaggaatttaagaataagggggtcgtgagagaggataaaaagatcccttacgactggacaatttattaccttcggaaaaaggccctgagccaggaaatcgagaaagaggaactcgcttggattctgcttaacttcaatcaaaagcgcggatattaccagctgagaggcgaggaagaggaagagaaccccaataagctcgttgaatattactccctgaaaatcgtggatgtcattgccgacgagaagcctaactctaaaagcgatatctggtactccctgcatctcgagaatgggtggatctatcggagaagctctaagattcccctgtttggatggaaagacaagacccgcgatttcatcgtgacaaccgaccttaacgacgatggcacggttaaaaaggacaaggaagggattgagaaacggtcctttagagctcctagcgaaaatgattgggtgctgctcaagaaaaagaccgagtctgacatcgaaaaatcccacaagacagtcggagcctacgtgtatgagaccctgcttcagaacccgatgcagaaggtgcgcggcaaactggtccggacaattgagagaaagttctacaaagatgaactcaagcaaatcctggagaaacagcgcgaatttcatcccgagctgcgggacgaggatctctataatgactgcgttagagaactgtaccgcagcaacgagacctatcagtttatcctttctaagcgggatttcgtgcacctgtttctcgacgatattctgttctaccaaagacctcttcgctcccaaaagagcgcgatcggcgactgtattctggaatttaaaacgtacaaggacaaagatgggaacaatatcaaggagtatctcaaagtgatttccaagtctaaccccctgtaccaggagttccggatctggcagtggctgtataatctcaagatctacagaaaagaagacgatgaggacgtcacactgcagtttattgccaacatcgaagataaggagcagcttttcgactttctgagcaatcggaaatccattgaacagaagcctctcctggagtatctgatcaaagctaagggacttaaaaagcaagtgaagaccgaagcctaccgctggaactatgttgaggataaaatttacccctgcagcgagacaaagaccatgatctctaccagactcgctaaagtggaaaatattccggacaacttctttacaaaggagatcgaacagaaactgtggcatatcatttactccgtcacggataagaatgagttcgaaaaggccctgcggacctttgcgaaaaagtatgacctcgatatcgccagcttcgtggacaacttcaaaaagattcctccctttaaaaatgagtacggctctttcagcgagaaggctatcaagaaactgcttcctctgatgagactcgggaagtattggaaatggaacgatattgacaataacacacagaatcgcatctccaagatcattaccggagaatacgacgaggaaatcaaagatattgttcgggagaagtctatcgccctgacaaacgagaacgactttcagggcctgcagctttggctcgctcaatatctggtgtacgggagacacagcgaagccgatattgccggaaagtggcactccgtcgctgacctggagaaatatctcaatgagttcaagcagcatagcctgcgcaaccccatcgtggaacagatcattaccgaaacgcttagagtcgtgcgggatatctggcgcaaatacggccagggcgcggagaatttcttctctgagattcacgttgaactggggagagacatgaagaacacagccgatgagcggaaaaagatcgtgaatgtcgtgaccgaaaacgagaataccaacctccgcattaaagctctgctgatggaacttaagaataactccgacggaaagctcgaggttgagaatgtgagaccctacagccctacacaacaggatatcctgaaaatctatgaagagtacgccatttctaccggcctggacaacgaaaaggatgagaaagtcaaggaagacatcaaaaagatttcccgggtggcccagccgacaacgaccgagctccaacgctataagctgtggcttgagcagaaatactgtagcccctatacagggaaggtgatccctctgggaaaactctttaccgaagagtaccagattgaacatatcattcccaagtccagatattacgatgactctttcagcaataaagttatctgcgaggctgccgtcaacaagctgaaggacaaatgtctgggccttgagtttatcaagaattaccacgggcagattgtggaaacaggcttcggacaaaaagtgaccatctttgatgaggaagcgtatcagaacttcgtcaagcagcactacgcttataaccattccaaacggacgaagctcctgctggaggaaattcctgagaagatgatcgagcgccagatgaatgacaccagatacatttctaaatttgtgctccccctgcttagcaacctggttcgggccaaggaaaatgataacggcgtcaattccaaaaacgtgctcccggtgaatgggaagatcacaaccatgctgaaacaagactggggactgaacgatgtttggaatgaccttatcctgcctagattcgtgcgcatgaacgagctcgccaagacaattgctttcaccagctggaatgaacagcaccagaagtatctgcccacggtccctctcgagctgtctaaaggctttcagaagaaacggatcgatcatagacaccatgccatggacgctcttgtgattgcctgcgcgacacgcgatcacgttaacctgctcaataacaagcacgccaataccgacacaatccggtacgatctgcaaagaaaactgcgccttttcgaacgggtgacctatattgacccccagaccaagaacaacgtcacaaaagacatccctaaggagtttaagaaaccctgggataatttcacggtggacgctagaaacgagctggaaaagatcattgtgtcctttaaacagaatctccgcatcattaacaaggccaccaatatctacacaaaatacgagaacgggaagaagattaaagtcggacaaaagggcctgaattgggctatccggaaaccgctccataaggaaaccgttttcgccaaagtgagcctgagaaagcggaagacagtgcgcctttctgaggcgctgaaagattggaagaaaattgtcgacaagaaactcaagcaggaaatcaagagactgacctgtcagtatgggaaatttgatgtggacacgatcctgcggtacttcaaggatcgcaaatatcagtttggcgaggttgacgtgtccaaggtcaaaatgtactatttcgatgaggaaaacgccgctgtgagaaagaatgttgacaccagctttacagagaaattcattcaaggatctgtgaccgatacaggcatccagaagattcttctgaaccacctcgaagccaaggggaataaagtcgagatcgctttcagccctgagggaattgaagagatgaacaagaatatcatccagctgaacgaaggcaaactccatctgcccatttttaaggtgcgggtttacgagaccatcgggaataaattctccgtgggagtcaagggcaacaagaaagacaagtatgtggaagccgccaaagggacaaatcttttcttcgctatttacgtggatgagaacggcatcagaagctacgagacgattcccctgaacatcgtcatcgaacgcctgaagcagggactctctgttgtgcctgagaaaaatcggaaggaacactccctgctgttttatcttagcccgaacgacctcgtgtacgtccccattgaggacgaaagagagaatatccacgcggtgaacctggatcaactcaataacgagcagcgcaagcggatttataaaatggtttcctgcaccggctctgaatgtcatttcgtgccttactatgtcgccagccccatcgtgaataaggttgagtactcctctctgaacaaaattgggagaagccttacaggagaaatgatcaaggacgtgtgcattaaactgaaggtcgatcgcctgggcaatatcaaggggatctccggactctga

SEQ ID NO: 4590 - RNA, 4533 nt, synthetic construct
  misc_feature 1..4533: note = Cas9 variant
  source 1..4533: mol_type = other RNA
atgaagagaatcctgggcctcgacctggggaccaacagcattggatgggcccttgtggattccgaggaacagcggatcctgggcatggggtctcgcattatccccatggaccaaggagtcctcgatacattcagcggcgggaatcctgttgagacgcagaccgctgccagaacagcgtaccggggaacccgcagactgcgggaacgcgcccttctgagacgggagcgcctcattagagtgctgaacatgatgaaatttctgccggaacactatgcttcccagatcgacttcgagaagcggctcggccagtttttcgatgagaaagaacccaagctggcctggaaacaaaatgacgagggccgctttgaatttatctttcagcagtctttcaacgagatgattgaggaatttaagaataagggggtggtcagagaggataaaaagatcccttacgactggacaatttattaccttcggaaaaaggctctgagccaggaaatcgagaaagaggaactcgcctggattctgcttaacttcaatcaaaagcgcggatattaccagctgagaggcgaggaagaggaagagaaccccaataagctcgtggaatattactccctgaaaatcgttgatgtgattgctgacgagaagcctaactctaaaggggatatctggtacagcctgcatctcgagaatggatggatctatcggagatccagcaagattcccctgtttggctggaaagacaagacccgcgatttcatcgtcacaaccgaccttaacgacgatgggacggtgaaaaaggacaaggaaggaattgagaaacggtcttttagagccccttccgaaaatgattgggttctgctcaagaaaaagaccgagagcgacatcgaaaaatctcacaagacagtgggcgcgtacgtctatgagaccctgcttcagaacccgatgcagaaggtgcgcggcaaactggtgcggacaattgagagaaagttctacaaagatgaactcaagcaaatcctggagaaacagcgcgagttccatcccgaactgcgggacgaggatctctataatgactgcgtcagagaactgtaccgctccaacgagacctatcagtttatccttagcaagcgggatttcgttcacctgtttctcgacgatattctgttctaccaaagacctcttcgctctcagaagtccgccatcggggactgtattctggaatttaaaacgtacaaggacaaagatggaaacaatatcaaggagtatctcaaagtgattagcaagtccaaccccctgtaccaggagttccggatctggcagtggctgtataatctcaagatctacagaaaagaagacgatgaggacgtgacactgcaatttattgctaacatcgaagataaggagcagcttttcgactttctgtctaatcggaaaagcattgaacagaagcctctcctggagtatctgatcaaagccaagggccttaaaaagcaggtcaagaccgaggcttaccgctggaactatgtggaagataaaatttacccctgctccgagacaaagaccatgatcagcaccagactcgccaaagttgaaaatattccggacaacttctttacaaaggagatcgaacaaaaactgtggcatatcatttactctgtgacggataagaatgagttcgaaaaggcgctgcggacctttgccaaaaagtatgacctcgatatcgcttccttcgtcgacaacttcaaaaagattcctccctttaaaaatgagtacgggagcttctctgagaaggccatcaagaaactgcttcctctgatgagactcggaaagtattggaaatggaacgatattgacaataacacacagaatcgcatcagcaagatcattaccggcgaatacgacgaggaaatcaaagatattgtgcgggagaagtccatcgctctgacaaacgagaacgactttcaggggctgcagctttggctcgcccaatatctggtttacggaagacactctgaagccgatattgctggcaagtggcacagcgtggcggacctggagaaatatctcaatgagttcaagcagcattccctgcgcaaccccatcgtcgaacagatcattaccgaaacgcttagagtggtccgggatatctggcgcaaatacggccagggggccgagaatttcttcagcgagattcacgtggaactgggaagagacatgaagaacacagctgatgagcggaaaaagatcgttaatgtggtcaccgaaaacgagaataccaacctccgcattaaagccctgctgatggaacttaagaataactctgacggcaagctcgaggtggagaatgttagaccctactcccctacacaacaggatatcctgaaaatctatgaagagtacgccattagcaccgggctggacaacgaaaaggatgagaaagtgaaggaagacatcaaaaagatttctcgggtcgctcagccgacaacgaccgagctccaacgctataagctgtggcttgagcagaaatactgttccccctatacaggaaaggtgatccctctgggcaaactctttaccgaagagtaccagattgaacatatcattcccaagagcagatattacgatgactccttctctaataaagtgatctgcgaggccgcggttaacaagctgaaggacaaatgtctggggcttgagtttatcaagaattaccacggccagattgtcgaaacaggattcggccaaaaagtgaccatctttgatgaggaggcttatcagaacttcgtgaagcagcactacgcctataaccggagcaaacgcacgaagctcctgctggaagaaattcctgagaagatgatcgagagacagatgaatgacacccggtacatttccaaatttgtcctccccctgctttctaacctggtgagagccgaagagaatgataacggggttaatagcaagaacgtgctcccggtcaatggaaaaatcacaaccatgctgaagcaagactggggcctgaacgatgtgtggaatgaccttatcctgcctcgcttcgttcggatgaacgaactcgctaaaacaattgccttcacctcctggaatgagcagcatcagaagtatctgcccacggtgcctctcgaactgagcaaggggtttcagaaaaagagaatcgatcaccgccatcacgctatggacgcccttgtcattgcgtgcgccacacgggatcatgtgaacctgctcaataacaaacacgctaataccgacacaatcagatacgatctgcaacgcaagctgcggcttttcgagagagttacctatattgacccccagaccaaaaacaacgtgacaaaggacatccctaaagagtttaagaagccctgggataatttcacggtcgacgcccgcaacgaactggagaaaatcattgtgtcttttaagcagaatctccggatcattaacaaagctaccaatatctacacaaagtacgaaaacggcaaaaagattaaggtgggacaaaaagggctgaattgggccatcagaaagccgctccacaaagagaccgtcttcgcgaaggtttccctgcggaaacgcaagacagtgagacttagcgaagccctgaaggattggaaaaagattgtggacaaaaagctcaaacaggagatcaagcggctgacctgtcagtatggcaagtttgatgtcgacacgatcctgcgctacttcaaagatagaaagtatcagtttggagaggtggacgtttctaaagtgaagatgtactatttcgatgaagagaacgctgccgtccggaaaaatgtggacacatcctttaccgaaaagttcattcaaggcagcgttaccgatacagggatccagaaaattcttctgaaccatctcgaggctaagggaaataaggtggagatcgccttctctcctgaaggcattgaggaaatgaacaaaaatatcatccagctgaacgaggggaagctccatctgcccatttttaaagtcagagtgtacgaaaccatcggaaataagttcagcgttggcgtgaaagggaacaagaaggacaaatatgtcgaggccgctaagggcacaaatctgtttttcgcgatttacgtggatgagaacggaatccgctcctacgaaacgattccccttaacatcgtgatcgagcggctgaaacagggcctcagcgtcgttcctgaaaagaatagaaaagagcactctctgctgttttatctttccccgaacgacctcgtgtacgtgcccattgaagacgagcgcgagaatatccacgccgtcaacctggatcaactcaataacgaacagcggaagagaatttataagatggtgagctgcaccgggtccgagtgtcacttcgttccttactatgtggcttctcccatcgtcaataaagtggaatacagctccctgaacaagattggacgctctcttacaggcgagatgatcaaagacgtttgcattaagctgaaagtggatcggctggggaatgtcaagggaatcagcggcctctga

SEQ ID NO: 4591 - RNA, 4536 nt, synthetic construct
  misc_feature 1..4536: note = Cas9 variant
  source 1..4536: mol_type = other RNA
atgaagaaaatcctgggcctcgacctggggaccaacagcattggatgggccgtgatcaattccgtcgctgatgagtctgttgaaaagagaaacattgagcttgccggcagccggatcattcccatggacgcggctgtgctggggaatttcgataacggagtgacaaaatcccagacggccgaacgcacctcttacagaagcatccggcgcctcagagagcggcaactgcttcgcagagaacggctgcacaaggtcctccagatcctgggctttctgcctgagcattatgtgaatgacattgatttcgagaaccacccggggaaaatcaagaagaatacagaacccaaactcccttggcgcaagaactccatgggacagtttgagttcatttttcaggcctctttcgaagctatgctgaccgactttgccacacatcaacccgttttcgtgagcgagggcaaaaaggtccactacgattggaccctttattacctgcggaaaaaggctctcacagaggaaatctccaaggaggaactggcctggattatccttaattttaaccagaaaagaggctattaccagctgcgcggggaggaagaggaggaacagagcaataagctcgtggagttctatgcgctgagagttgtgaaagtcgaagccaccgacgataagaaaggaaaggacacgtggtacaacgtgcatctggagaatggctggatttaccggcgcacctctaacatccctctcgattgggaagggaaagtgaaggagtttatcgtcacaaccgacctgaatgaggatggaacacccaaacttgacaaatatggcgaagttaagagatccttccgggctcctaaagaggacgattggaccctgattaagaaaaagacggaaagcgacatcgccaactctcacaagacactcgggtgctacatttatgatgctctgcttcaaaacccgaatcagaaaatcaagggaagactggtgcgcaccgtggagcggaaattttacaaggaggagctcagactgattctggagaaacagctctccttccaccccgaactgcaggaccgcgatctttatcgggcctgtatcgacgcgctgtacgtcagcaacgaggcccataagaataacatctctggcagagatttcgtgtatctctttattgacgatatcattttctaccaacgccctctgaagaccaaaaagtcccttatcgacaattgcccctacgagaaaaaccagtatatggatcgggagacaggcgaggttaagcaggctcctattaaatgtatcgccaagagccaccccctgtttcaagagttcagactctggcagtttatctccaatattcgcatctaccagcgggaaagagtgatggacgacgggaagctggaaaccgatgtcgacgtgacaccggatttcctgaaaacggaggacgattataccacactctttgaatggctgaacgaccgcaaggaggttgatcagaaggctttccttaagaatcctcaatttggactgaaaaagaccttcacagagtaccggtggaactatgtggaagacaaatcttacccctgcaatgagaccagaaacgccattctcaatggcctgcagaaggccggggtcagcgctgattttctgtcccgggaagtggaggaagcgctttggcatatcctctatagcgtcgaggacaagattgagatcgaatctgccctgcgcaaattcgcttccaagcacgatctggacgatagatttgccgacgtgttcaaaaagctccctcccttccggaaagagtacggagcctacagcgctaaggccattaagaaactgcttcccctgatgagaatgggcaagtattgggaactctctaacatcgacgataaaacgaaggagcgcatcgacaaaattatcacaggggaatgggatgagaatattcacaaccgggttagagagaaggcgatcaagctgagcgacattaccgattttaaaggactgcctctttggctctcctgttacgtggtctataaccgccattctgaagctagagccatcgccaagtgggagagcccggaagacatcgattcctacctgcggctgttccgccagcacagcctcagaaatcccgtggttgaacaggtgattaccgagacactgcggaccgtccgcgacatctggaaaagaattggccaaatcgatgaaattcatgtggagcttggccgggaaatcaagaaccctgctgacaaacgcgccaagatgacagctcagatcgtggagaatgaaaacacgaatctgagaattaaggccctcctggcggagtttatcaactctgagtatgaaattgagaatgttcggccctactcccctgggcagcaggaaatcctgcgcatttatgaggataccgtccttaacagcgtggaagagatccccgaggacatctctgccgtgctcaaaaagttcagagaatccgatctgaaaaagcggccgacaaaaagcgagtttctgagatacaagctctggctggaacaaaaataccgctccccttataccggagacattatcccccttggcaagctgttcacatctgcttacgagattgaacacatcattcctcagagccggtattttgacgattccttctctaataaggtcatctgcgaggccgaggtgaacaaactcaagagcaatgaactggggtacgagtttattaaaaaccatcacggacagtatgttgaaatcggcttcgggaaggtggtccagatcttttccattgaggcttacgagaaattcgtgaaggccaattatagcggcatcggatctaagatgaaaagactgcttatggacgatattcccgaaacctttatcgagcgccaactcaacgactcccggtacattagcaaggttgtgaaatctctgctgtccaatatcgtcagagaaaaggatagcaacggcgagtacgaacctgaggcgatctctaaaaacgtgattgtttgtacggggagcgtgaccgaccgcctcaagcgggattggggagtcaatgacgtgtggaactccatcatttatcccagattcgagcgcctgaatgaacttacaggcagccagcagttcgggtgctgggagaacaaggaaggaaaacgggtgtttcaaaccgccgtcccgctggagatgcagaagggcttctctaaaaagagaatcgatcaccggcatcacgctatggacgccattgttatcgcttgtgccatccgcaatcatattaactacctctccaatgaaagcgcctccaaaaaggctaagatctctagaattgatctgcagcggctgctttgcacaaaatgtcgcaccgacgacaacgggaattataagtggatcgtgaaaaagccttggcccgcgtttacgcaggatattagaaaagccctggagaacatcacagtgagcttcaagcaaaatctccgggtcattaacaagaccacaaattactatgtgcactttgacgagtccggcaaaaaggttctggaaaaacagatcaacggagattcttgggctatcagaaagcccatgcacaaagacaccgtgttcggcaaggtcaatctccagaaagtgaaggaggttcgcctgagccttgccctggatacccctaagatgattgtggacaaaaagctcaaagaaaaggtcctgcagctgtactcctataaatacgataagaagcggatcgacaaatactttaaggagaacgcctctctttggaaagatctgaacctcagcaaggtggctgtttattacttcacaaatgactccacggaaccgctggtggccgtcagaaaacccctcgataccagctttaacgcgaagaagattaaagagtctgtgacagacaccgggatccaaaagattctgcttaatcatctgtccaacaatcaggataaccctaatctcgctttcagccccgacggaatcgacgagatgaaccgcaatctgacaaccctgaacgatggcaaatatcaccagcctatctacaaggtgcgggtctgcgaaccccaggggaataaattttctgttggaacgtccggcaacaagacaagcaagtatgtggaggccgccaaagggaccaatcttttcttcgctgtgtaccaaaccgaagacggcaagagaaactatgagacaattcctctgaatgtcgtgatcgagcgcgaaaaactcgagtgggcccccgttccggaaaacaataacaacggagataagctgctcttttggctgtctcctaatgaccttgtgtacgtccccaccgcggatgagctgaacaatggcatgcggctggacaacatggataaagggagaatttacaagatgatctcctgcagcggacctcagtgtttctttattccccagaatgtgtccaacccgatcatccctgttattgaactcggcgtgaataacaaagctgaaaagagctggaataacgagatgatcaaggtcgtgtgcgtccccattcgcgtggacagactggggtgtatcacacaaattaataaccagaaatga

SEQ ID NO: 4592 - RNA, 4539 nt, synthetic construct
  misc_feature 1..4539: note = Cas9 variant
  source 1..4539: mol_type = other RNA
atgaagaaaatcctgggcctcgacctggggaccaacagcattggatgggcccttatcgaaaattccttcacagaaaaggagggcaaaattaacgatatgggggtgagaatcattcccatgtctgctgacatcctgggaaagtttgatgccggccagagccactcccaaacggcggaacggaccgggtaccgcggaacaagacggctctatcagcgcgacaatctgagacgggagcgccttcatagagtcctgcacatcctcggcttcctgcctaaacattacgatgaacacattgactttgagaagcggctgggccagttcaaggaggggaaagaaatcaagctcaactatcgctgcaatgttgagaacaaacatgaatttattttcatctctagctttaatgagatgctgaccgagttcaagaaagctcagccggaactgttttaccttaagtccaacggagaggaaacaaagattccctatgattggaccctctactatctgagaaagaaggccctttctcaacctctgacaaaacaggagctcgcctggatcattctgaatttcaaccagaagcggggctactaccagctgcgcggggaagagatcgacgatgacaaaaataagcaatttgtgaaactcaaggtgaaggaggtcatcaacagcggagaagctgtgaaaggcaagcccctgttcgatgttatttttgagaatgggtggaaatatgacaaacaggtggtcaaaaccgaagattggatcgacagaacgaaggagttcattgtgaccacaaaggttcttaaaaacggagacctgaagcggtcctacaaaaccgtggatagcgaaaaggactgggccgctatcaaagccaagacagagcaggatattgagcgctctaataagaccgtcggcgagttcatctatgagacgctcctggaaaaccctacacagaaaatcagaggcaaacttgtgaaaaccattgagcggaagttttacaaagaggaactgaagaacatcctcattaagcaaatcgagctgcagcccacactgttctccgaggaactctataaagcgtgtattgaggaactgtaccctagaaatgaggcccaccagaacgctatcaagaatcgcgactttatctatcttctgatggatgacattatcttctaccaacggccgctcaaaagccagaagtctaacatttccgggtgccagctggaacagagagtgtactataaagccaataaggatagcggagagaacgaagaggtcaaacaagctgttaaggccatccccaagtctcaccctctttttcaggagttccgcaattggcagtggctgcagaacctcaaaatttacaataaggtggacaccgaaaaaggcgagctgaccgatgtgacaaagcaactgctcccctccgaagacagctgggtcaacctgtttaatttccttcagtgtaaaaaggagctggaacagaagcagtttatcaaatatttcattgataagaaactcatcaacaagacggagaaagaccattaccggtggaattatgtggaagacaagaagtacccttttaccgagacaagagcgcaattcatctcccgcctgaccaaagttgaggggattgaagagatcaacacatttctggataagaaaacccagattggaacgaaggacaattctcccttcgtgagccggatcgaacagctttggcacattatctattccgtcagcgatatcaaagagtacgaatctgccctcgagaagttcgctattaagcatcacctgaacgaggaatcctttgtggccaacttcatcaaatttccgcctttcaagagcgactacggctcttatagcaaaaaggctctgaataaactcctgccccttatgagacgcgggaactactggacagagaatgatatttccgaaaaggttaaactgcgggtgtctgagatcatggagagagtcaacgccctcaatctgaaggaagactatagctccaaggagctggccgaaacccttgtgaacgtcagcgatgacgatgtgaaaaagcagctcattaaatcttttgtttccttcaaggaccgcaatcctctgatgggactgaacacctttcaagctacatacctcgtgtatggccggcacagcgaggtcggcgatatccagaattggaaaacccccgacgatatcgacacatacctgaagaacttcaagcagcattctcttagaaatcccattgtggaacaagttgtgacggagaccctgcgggtcgtgcgcgacatctggaaacaccatgggaagtcccagacaaactttttcaatgagattcacgtggaactcggaagagagatgaaaaaccctgcggataagcggaaaagaatcagcgaacgcaataccgagaacgaaaacacaaataaccggattagagagatcctgaaggacctgatgaatgatgcctccatccagggcgacgttcgcgattattctccgagccagcaagggattcttaagatctacgaggaaggagtctaccagaaccccaaagtggactattccaaggtgtctgaggatgaaattaccaaaatcagacggagcaataaccctacgcagaaggagattcagcgctacagactctggctggaacaaggctatatctccccctatacctgcaaacctattcccctgagcaagctctttacacatcactaccagatcgagcacatcattccgcagtctcggtacttcgacaattccagctctaacaagatcatttgtgagtccgaagtcaatgaggataaagacaacaagaccgcttttgaatatctgaaagataagggggagaatgtgatcaacggccataaacttctgagcctcgccgcctacgaggctcacgttaataagtacttcaagaacaatcgccagaaactgaagaacctgctttctgaagacattcctgagggattcatcaacagacaaatgaatgatagccggtatatctccaaactcgtgaagggcctgctgagcaacattgtccgcgaagagggggaacaggaggtgacatctaaaaatctcatccccgttaccggatccgtgacgagcaagctgaaaaacgactggggccttaatgacaagtggaacgagctgattctccctagatttaagcggctgaatcagctgacacaaaccaacgatttcacaaccgccaataccaacgggaatacaatccccacggtccctgacgaacttctgaaaggattttccaagaaacgcattgatcatagacaccacgcgctcgacgctctggtggttgcctgctgtacccggaaccattctaattacctcagcgccctgaacacagagaataagaactatggccttagagataaactgctcatcaagaatgacaacgatcactacaccaagtccttccagatgccctggcatgggtttacaaccgaagctaaaaaccagctggaggaaacggtgatctctttcaagcagaatctgcgcgtcattaacaaagccaataacaagttttggagctataaagacgagaatggcaaacttaacctggataagaatggaaaaccgatcaagaaactccggaagcaaacaaaaggcgacaactgggctgtgagacagcctctgcacgaggaaaccatttccgggatcgtgaatctcccctgggtcaaggccgagaaggaaaaattcacctacgcgacacgcaagtctctggataagagctttgaccttaagaaaattgagaagatcaccgacacaggcattcagaaaatcctgcggaactatctcatgcaggaaaagttcaaggagctggataaaaaggacaaagaggtttacaattccgaactggcctttagccaagagggacttgaagatctgaactctaatatcgagcagttcaacgaccagaagccccataaacctatttacaaggtgagactcttcgagaaggggtccggacgctttgctctgggcttcaaagggatcaatgccaagaaatatgctcagggcagcccgaacctctactttaacatttatcggaatgaagatggacaatactatgagacggtgcccctgaacaaggtcatcattcaccagaaaaatgccgcgaacatgcctaagaagaatagaacccccgtgcctatctctaacacagccatcaatcgctccaaagaagttcttgtggactacaagatgaccctgagccccctggatctcgtctatattcctacagaggaggaactgaacaatatcaactctcttgacttcaataacctgtccaaaagccagcggaagagactctacaatgtgaacgatttttccggctacaccatttatttcagccccaatacgctggctaaatctatctgcccgaaggaggttgacatgaagtttgatgaaaagaagcagaaacctaccgggagcttcgactccaagacagcctctctcgatggaatgagcattaaagagcggtgtatcaagctgatcattgaccgccttggcaacatctccaaagcttga

SEQ ID NO: 4593 - RNA, 4539 nt, synthetic construct
  misc_feature 1..4539: note = Cas9 variant
  source 1..4539: mol_type = other RNA
atgaagaaaatcctgggcctcgacctggggaccaacagcattggatgggccgtggtcaatgctgatgagatcacaagagacgatggctcccggtaccttaagcccaacgggatttctgccgcgggaagccgcatcattcctatgtccgctgacatcctgggcgatttcgaaaaagggaatagcatcagccagacggccgagagaacccggatgcgcatggccagacggctccacgaacgcgctctgcttagacgggagcgcctgctcagagttctgaacctgctcgactttctgccgaagcatttcgccgataaaattgaccggtatggaaagtttacagatgactccgaacccaagctggcttggcgcaaaaataccgagggcaagtacgagttcatctttcaagatgccttcaacgaaatgctggcggagtttaaagacaagcagcctgaaattgtggaggagggcaaaaagatcccctatgattggacaatttactatctcagaaagaaagccctggaaaaggctctttctaaagaggaactgagctggatcctcctgcagttcaatcagaagcgggggtactatcaactgcgcggagaggaagaggagattcctcaggacaaaaagatcgaatacctcgcccagaaagtggtcaaggtggaggctaccgaccagaagaaaggcgatgacgtttggtacaacgtgtatctggaaaatgggatgatctacagacggacatccaaggcgccccttgattgggagggaaaagtcaaggaatttattgtgaccacggaggttgagaacgacggcgaaacccctaaaaaggataaggaggggaatatcaaaagatctttccgcgccccgaaggaagacgattggacactgctcaaaaagaaaaccgaggccgacattgaaaactctcacaagacagtgggatgctatatctacgattccctgcttaataaccccaagcagaaaattatcggcaagctggtccggaccgtggagagaaaattttataaggaggaactcacgcagatcctgaaaaagcaagtggagctgattcctgaactccgcgacgataatctgtacaagcagtgtatcgaggagctttatcccattaacgaagctcatcggaacacaatcgccaaaaccgacttcgctaatctgtttattaacgacatcctcttctaccaaagacctcttaagagcaaaaagtctcagatcgataattgcccctacgaggaacgcattttcatcgactccaaaacaggcgagaagaaaaaggtcccggttaagtgtattgccaaaagcaaccctctttttcaggagttccggctgtggcaatttatccagaatctcagaatttatcagcgcgaaaaggagatcgatgggaaactgctgaccgacattgatatcacctctgaatgcctcaagtccgaggaagactacgtgcggctgttcgattggcttaacgacagagagacaatcgaacaggaggatctgctcaaacacctgtttaatacgaaaaagagcaagaacaaggagaatccctatcgctggaactacgtggaagacaaagtctatccttgtaatgagacccgggccacaattctgaagggattctccaaatgcggcatcaacgcttctgtgcttagccccgaactcgagatggcgctgtggcatattctgtactccgttgaagataagaaggagatcgagaccgccctcacacactttgctcaaaaacaggggtggaatgacgatttcgccaaggtgtttagcaaagccaagcccttcaaaaaggactatggatcttactccgaaaaggctattaaaaagctgcttagcctgatgagaatgggcaaatactggaaccaggacaatatcgataagaacaccctcgaccggatcgataaaattatcaacggggagtatgacgaaaagatttctaatcgcgtcagagataacgccatcaatctgaaagacattagcgattttcggggactgcctgtgtggcttgcgtgttacatcgtttatgacagacactccgaggctaaggattgcacgaagtggaactctccggaggaaatcgacagctacctcaaaaagttcaaacagcattccctgcgcaatcccattgtggagcaagtcgtgacagaaaccctgcggaccgtcagagatatctggattcaggaggaacagatcgacgagattcacctcgagctgggccgcgatcttaagaaccctgccgacaaaagaaagaagatgagcgaaaatatcctgaaaaacgagaatacaaacctccggatcaaggccatgctgatggaatttatgaatccctctatgggcattgagaacgtgcgcccttattcccccagccagcaagacatcctgagaatttacgaagagaatgctcttgataacctcaccaaagacgataaggacttcgatttcatctctaaaatttccaagcaggcccagccgagcaagacagacatcattcggtataaatgttggctggagcagaagtaccgctccccttacacggggaaaaccatctctctgagcaagctctttacacccgcttatgaaatcgagcatgttattcctcaatccctgtacttcgatgactcttttagcaataaagtgatctgcgaagccgaggtcaacaaacttaaggatagacagctgggatataagttcattgcggaacaccacggcgagaaggtgcagctctcccaaggggaggttgtggaaatcctgagcgtcgacgcctacgagaaatttgtgaaggaaaactatgctaataaccggattaaaatgaagaagctgcttatggagtctatccccgatgagttcatcgaacgccagctcaatgactccagatacattagcaaagtggttaagggactgctgtctaacatcgtccgggagaaaattgacgatgaaaattatgagcctgaagccgtgtccaagaacctcatcagctgtaatggcgctattaccgaccgcctgaaaaaggattgggggatgaacgacgtgtggaactctatcatccttcccagatttattcggatgaatcagatcacaggcaaagattgcttcaccacgaccaatgccgagggacatctgattccgcagatgcctctcgagctgcaaaagggctttaacaagaaaagaatcgaccaccgccatcacgcgatggatgccattgtcatcgcttgcacaacccgggaccatgtgaatctgcttaacaatgaagccgctcacagcaagttcaacgccacaagataccagctgcagcgcaaactccggagatttgagaaggccgttattgatgggaaagaacgcgaggtggctaaggagttcctgaagccctgggactcctttagctctgattccaaaaacatcctcgaaaatatcattgtcagcttcaagcagaaccaacgggtgatcaataaaaccacgaacgcgttcctgcactttgacgagaatggaaagaaaacattcattaagcagggcaagggggattcctgggccatcagaaaatctatgcataaggacaccgtttttggagaaattaaccttcgcaaagtgcggagcgtctccctgaatgaggctatcaaggtgcccgaaagagttctcaacaaaaagatcaaggagaaaattctggaactgaagaataacaaaatcgacgccaagaatattaaaaagtacatcgaggagaaccacacaggcgggtatggcattgattctagcaaaatcgacgtgttctactttaccaaggaaaccaaggagcggttctttgccacacgcaaaacgcttgatacctccttcaatcaggctaagatcaaagactctattgccgatagcggaatccagaagattctgctcgcgcatctgaaatccaagaacggcgacgctgaacaagcctttagccctgatgggatcgacgagatgaataagaacattgtcgagctcaataacggaaaattccaccagccgatcctgaaggtgagagtgtatgaaaaagccgataagtttgctgtcggccagaaagggaacaagaaggttaaattcgtggaggccgcgaagggaacaaatcttttctttgctattttcgaaaaagacggcaagcggtcttacctgaccatccccctcaacgtgatgatcgattgtcaaaaacagtatgggaatcagtggaagaacaatattgaggcctacctgaaggaaaaagagctggtcgagaaggacgtgaaacttcagtttatcctgtcccctaacgatctcgtttatctgcccacagaaggcagcattgacaagaaacgcatctacaaggtggtctctttcaccaataacagactctacgccattccttatgctatcgccaaatccatcgtggacaagaatgagtttacgcaactgaacaagattgagttcacagataataaagaaagcatcaaggacgcttgcgttcccgtgattatcgatcggcttggaaacgtcattgaatttaatggcaaaagactgtga

SEQ ID NO: 4594 - RNA, 4539 nt, synthetic construct
  misc_feature 1..4539: note = Cas9 variant
  source 1..4539: mol_type = other RNA
atgaagaacatcctgggcctcgacctggggaccaatagcattggatgggccgtgatcaactccgaggaagatggccccattgtcaaaaagagaatcgagcttgctgggtctcggattatccctatggacgccgcggttctgggaaatttcgatagcggcgtgacaaaatcccagacggctgaacgcacctcttttagaagcatccggcgcctcagagagcggcaactgcttcgcagagaacggctgcacaaggtgctccagattctggggttcctgccggagcattacgtcaacgacatcgattttgagaatcaccccggaaaaattaagcgcaacacagaacctaagctcccctggcggaaaaattccatgggccagttcgagtttatcttccaggactcttttgaagccatgctgaccgatttcgccacacatcaacctgtgtttgttagcgagggcaagaaagtgccctatgactggaccctttactatctgagaaagaaagctctcacagaggggatttccaaggaggaactggcctggcttatcctgaacttcaatcagaagcgcggatactatcagctcagaggcgaagaggaagaggagcagagcaacaaactggtcgaattttacgctctgcgggtggttaaggtggaggccaccgatgacaaaaaggggaaagatacgtggtataatgtccacctcgaaaacggatggatttaccgcagaacctctaatatccctctggactgggagggcaaggtgaaagaatttatcgtgacaaccgatcttaacgaggacgggacaccgaagctggacaagtacggagaggtcaaacggtcctttagagcgcccaaggaagatgactggaccctcattaaaaagaaaacggagagcgatatcgccaattctcataagacagttggctgctatatttacgacgctctgcttcaaaaccctcaccagaagatcaaaggccgcctggtgcggaccgtggaaagaaagttctataaagaggaactccgcctgattctggagaagcagctctccttccaccccgagctgcaggatcgggacctttacagagcctgtatcgatgctctgtatgtcagcaacgaagcccataaaaataacatctctgggcgcgactttgtgtacctcttcattgatgacatcattttctatcaacggcctctgaagacaaagaaatcccttatcgataattgcccctacgaggaaaaccagtacatggacagagagaccggagaggttaagcaggcgccgattaaatgtatcgccaagagccaccctctgttccaagaatttcgcctctggcagttcatctccaatattcggatctatcagagagagcgcgtgctggacgatggcaaactggaaaccgacgtcgatgtgacacccgactttctcaagacggaggatgactacaccacactgttcgaatggtttaacgatcggaaggaggttgaccagaaggctttccttaaaaatcctcaatttgggctgaaaaagaccttcacagagtatagatggaactacgtggaagataaatcttatccctgcaatgagacccggaacgccattctcaatggactgcagaaggctggcgtcagcgccgactttctgtcccgcgaagtggaggaagccctttggcatatcctctacagcgtcgaggataaaattgagatcgaatctgctctgagaaagttcgcgtccaagcacgacctggatgaccggttcgccgacgtgtttaaaaagctccctcccttcaaaaaggagtatggggcttacagcgccaaagccattaagaagctgcttccgctgatgagaatcggaaaatactgggaactctctaacatcgatgacaagacgaaagagcgcattgataagatcattacaggcgaatgggacgagaatatccacgatcgggttagagagaaagctattaagctgagcgacatcaccgattttaagggcctgcccctttggctctcctgttatgtggtctacaaccgccattctgaagccagagcgatcgctaaatgggagagccctgaagacattgattcctatctgcggctgttccgccagcacagcctcagaaatcccatcgtggagcaggttattaccgagacactgcggaccgtgcgcgacatctggaagagagtcgggcaaattgatgaaatccatgtggagcttggacgggaaatcaaaaaccctgccgacaagcgcgccaaaatgacagctcagattgtggagaacgaaaatacgaacctgagaatcaaggccctcctggctgagtttattaattctgagtacgaaatcgagaacgttcggccctattccagcaatcagcaggaaaagctgaaaatttacgaggataccgtccttaacggcgtgaaggaaatcccggaggacatcaatacaattctcaaaaagttccgcgagtctgacctgaaaaagagacctaccaaatccgattttctgcactataagctctggctggaacaaaagtactgcagcccctacacagggcggatcattcctcttggaaaactgttcacctccgcctatgagatcgaacatattatcccccaggcgcactactttgacgattctttcagcaacaaggtgatttgtgaggccgaagtcaatggcctcaaagacaagaaactggggtatgagtttatcaagcacaaccctggcaagatggtggagatcggattcggcaaacccccggttagaatcttttccgtggaagagtacgaacgcttcgtcaaggagaattattctgggattaaaaacaagatgaataaactgcttatggatgacattcctgagacgttcatcgaacggcagctcaacgatagcagatacatttccaaggtggttaagagcctgctgtctaatatcgtgcgcgagaaagactccaacggagaatatgagcccgaagctatcagcaagaacgtcattgtgtgcaccggctctgttacagatcggctcaaaagagactggggagtgaatgatgtctggaactccatcatttacccccgctttgagcggctgaatgagcttaccgggagccagcaattcggctgttgggaaaacaaggaggggaaaagagtgtttcagacagccgtgcctctggaaatgcagaagggcttctctaagaaacgcatcgaccatcggcaccatgctatggacgccattgtcatcgcgtgcgccaccagaaatcacatcaactacctcagcaatgagtccgctagcaagaaagccaagatttctcggacggatctgcaacgcctgctttgtacaaaatgcagaaccgacgataacggaaattataagtggatcgttaagaaaccgtggcccgcttttacacaggacattcggaaggccctggaaaacatcaccgtgtccttcaaacagaatctccgcgtgattaacaagaccacaaattactatgtccactttgatgagagcggcaaaaaggtgctggagaaacagatcaacggggactcctgggccattagaaagcctatgcataaggatacggttttcggaaaagtgaatctccaaaaggtcaaagaagtgcggctgtctcttgctctggacacccccaagatgatcgttgataaaaagctcaaggagaaagtgctgcagctgtacagctataagtacgacaaaaagagaatcgataaatattttaaggaaaacgcgtccctttggaaggacctgaacctctctaaagtcgccgtgtactacttcacaaatgatagcaccgagcctctggttgctgtgcgcaagcccctcgacacatcctttaacgccaaaaagattaaagaatctgtcaccgacacgggcatccagaagattctgcttaatcacctgagcaacaatcaggatgaccctaacctcgccttctcccccgatgggatcgacaagatgaataaaaacctgacagctctgaatgatggaaagtatcatcaaccgatttacaaagtgcgggtgtgcgagcctcagggcaacaagttcagcgtcgggacctctggcaataaaacctccaagtatgttgaggccgcgaaaggaacaaacctgtttttcgctgtgtaccagaccgaagacggcaagagaagctatgagacaatcccccttaatgtggtcatcgaacgcgagaagctcgggtggacgcctgtgcccgagaacaataacaatggagataaactgctcttttggctgtctccgaacgaccttgtttacgtgcctaccgccgatgaactgaacaatggcatgcggctggacaacatggataaggggagaatttataaaatgatctcctgtagcggaccccagtgcttctttattcctcaaaatgtctctaacgccatcattcccgtgatcgagctcggcgctaataacaaggccgaaaaatcctggaataacgagatgatcaaggttgtgtgtgtccccattcgcgtggaccggctggggtgcatcacacagattaataaccagaagtga

SEQ ID NO: 4595 - RNA, 4551 nt, synthetic construct
  misc_feature 1..4551: note = Cas9 variant
  source 1..4551: mol_type = other RNA
atgaagaacatcctgggcctcgacctggggaccaatagcattggatggtccgtgatccaggagaaacacaacgaaaataacgagtgccaaaaacttattctgggcgccgggtctagaatcattcccatggatgctgccgtcctcggagacttcgcgaaaggcaatacaatcagccagacgaaggatcggacccagtaccgcggggttagacggctgcgcgaaagatgtcttctgcggcgcgagagactctttcgggtgctggacatcatgggattcctgcctcagcatttttccaacgctctcacacgctatggcaaattcaaggatgccgacgaggaaccgaagattgcctggagaaaagatgacgagggcaagatgcactttctgttcgctgattcttttaatgaaatgatcgaggagttccggagcgtgcaacccgaacttctgaaacgcgggatgaaggtcccttacgactggaccctctattacctgcggaaaaaggccatgcgggaggctgtgacaccctttgaacttgcctggctgattctctccttcaaccagaagcgcggatattaccagctgagaggcgaggaagagggggaagcggataattctaaaagcgaggagtatctggcccagcgggttgtggacgtcatcgataccggagaaaagaaaggcaagtccacatggtttgacattgtgctcgagaacgggatggtttaccatagacctgctgaaatcaaacccgactggattggaaagaccaaagagttcatcgtgacgacccaatttgataaggacggcaatcctaagaaagataaggaaggcaacgtcaaaatgagcttccgcatgccgaatgagaacgactggaatctgcagaagaaaaaggccgagaaggatatcgacgaatctgggatgacagtgggagagtacatttataacgcccttctgcacaaccccaaacagaagatcaaaggcaagctcgtgcgggtcgttgaaagaaaatactataagaatgagctgcagaagattcttgaatcccaaaaacgcttcatccctcagctgagcgattctgctctctacgagaagtgcattaaagagctgtatcagtccaacgaagcgtaccggaatagcatctctaccagaaacgactttacatatctgttcgtggataatatcatcttttaccaacgccccctcaagtccaaaaagagcctgattgacaactgtccttacgagtcccttgcctataccaaggatggggaggaacataaagctcccgtgaagtgcattgccaaatctcacccgctgtaccaggagttccggctctggcagtttatcagcaatctgagaatttatcagcgccaaaagcaggtcggagacaaagtgaaacttgacgttgatgtgacggacgagttcctgcctacagatgaccggagagaatccctctttgattacctgaacgacaaaaccgaaatcaagcaggatgtcctgctcaaggagttctttagcatgaaaaagcccaaaggcaaggactctgtgtatccttaccgctggaattatgttgaagataaatcctacccctgtaacgtgacacgggggaagatcctggctaaacttaatagagccggaattagcgccgacttcctgtctagcaacggcaatgaggagtccctctggcacatcctgtactctgtcgaagataagggcgagctgcggaaggctcttgcgcgctttgccgctaaaaacgggctcgacgatgccttcaccgaagccctggctgacattgagccctataagaaagaatacggagcctatagcgcgaaggctctgaagaaactcctgcctcttatgagactgggcaagtactggaattatgacaacatcgccccggccaccaaagctcggatttccaagatcattgatggggagtacgacgagaacatcagaaatcgcgtgcgggaaaaagccatgagcctcaactctgcttcccagtttcaaggactgcccctgtggcttgcctgctatatcgtctacgatagacatagcgagcgcgcggactctggcagatggtccagccctgaagatattgacaagtacctctccgatttcaagcagcactctctgcggaatcccatcgtggagcaggttgtgacagaaacgctgcgcaccgtcagagacatttggaaacggtatggggagatcagcgagattcatgtggaactcggccgcgagatgaagaaccctgccgataaaagatccaagatgaatcggcgcatgctggaaaacgagaatgctaacatgagagccaaacttctgctcacagagttcatgaatcccgaatttggaatcgagaacgttcggtcttacagcccgtcccagcaagaactgctgcgcatctatgaggacggcgctattagcaatgccgggtctgaaatcgatgacgagatttccgatatcatgagcagactttctcaggtggacgtcaagaaacagcctaccgcgtccgaggtgaagcggtacattctctggctggaacagaactatagaagcccctacacaggacaaatgatccctctggccaaactcttcacccccgcttatgagatcgaacacgtgattcctcagtctcgctactttgacgatagcttctccaataaggttatctgtgaggccgaagtcaacaagctgaaagaccggatgcttggctacgagtttattaagcagcacaaaggggagaaggtgagcctgtctatgggaggcacggtggaaatcctctcccccgaggaatatgtcagacatgtggagagccaatacaagaataacaaagctaagatgcgcaaactgctgatggatgacattccggatgagttcatcaaccggcagcttaatgactccagatatatctctaagctcattatcagcctgctgtccaacattgttcgcgaagagggggaagaggaagccacatctaaaaatgtgatcagctgcaacggctccattaccgatcggctcaagaaggactggggaatcaatgatgtctggaaccacattatcctgcctagatttcgccggcttaatgagctgaccggcacagacaaattcaccacatctaacaaggaggggcatgaagtgcccgagatgcccctcgaactgcagaaaggatttaataagaaaagaatcgatcaccggcatcacgccatggacgctattgttatcgcgtgtattacgcgcgaccacgtgaacctgcttaataacgaggccgctatgagcaagaataacgccaatagaatccagctgtccaagaaactccggcgctacgaaagcgtcgagattgagaaggatggcatcagaaaacaaatctctatggccaaggagttcaaaaagccttgggaagggtttaccgctgacgtggaacggacactgagagatattgttgtgtccttcaagcagaacctccgcgtcatcaacaaaaccacaaattattaccagcattttaaggacggaaagaagatttatagcccgcagtctaaaggcgattcctgggccatcagaaagagcatgcacaaagagaccgtgttcggggaaattaacatcagacgcatcaaggaggtgtctctgaaggaggcgatgaaacggattaaggacatcgctgataaagaacttagatccaagattgtcgagctgatggccctccaatacaatgaaaagaagatcaagcagtacttcagcgacaacaaagatgagtggtccgacgttaatcccaagaaaattaagatccattattttacgaaagaaaccaacgagcgcttctttgccacacggaagcctctggataccagcttcgacaagaaaaagattaaaacacaggtggctgataccgccatccagaagatcctgcttaatcacctgtctgcgcacggcgacaaagctgagacggcctttagccccgacggaattgatgaaatgaacagaaatatcattgagctcaacgacggcaagttccatcaacctatcctgaaggtgcgcatttacgaaaaagccgataagtatgctgtcgggcagcagggaaataaaaagaaaaagtacgtggaggccgctaaaggcacaaacctctttttcgccatctatgcggaggaaaagatcgacgagaagaccggggatacagttattaccagaacctacgactccatccccctgaatgtggtcattgatcgggaaaaacgcggactttctcctgtgcccgagaacgaaaatggcgccaagccgaaatatgttctgagccctaacgacctcgtgtacgtccccaatgaggaggaaagagagacagggcggatctgcgaacctctggataaggagcgcatttacaaaatggtgtcctctaacaagaagcaagcctttttcatcaaaagcgaagttgcttccacgatcgtggacaagtttgagttctctgctctgaacaaacaggagagagcccttagcggcgaaatgattaaggagatctgtattcccatctccattaatcggatcggagaaattaccctgagatga

SEQ ID NO: 4596 - RNA, 4554 nt, synthetic construct
  misc_feature 1..4554: note = Cas9 variant
  source 1..4554: mol_type = other RNA
atgaagaaaatcgtgggcctggacctcgggaccaacagcattggatgggccctgatcaatgcttacattaacaaggagcacctttatggcatcgaagcctgcgggtccagaattatccccatggatgcggctatcctgggaaatttcgacaaaggcaactctattagccagacagccgatcggacgtcctaccgcgggatcagacggctccgcgagagacatctgcttcggcgcgaaagactgcaccggattctcgacctgctgggatttctccctaagcattattctgatagcctgaatcgctacggcaaattccttaacgacatcgagtgtaagctgccgtgggtcaaggatgaaaccggctcctataaatttattttccaagagtcttttaaggagatgctcgccaatttcacagaacaccatcccatcctgattgctaacaataaaaaggttccttacgactggaccatctattaccttcggaaaaaggccctgacacagaagatcagcaaagaggaactcgcttggattctgctgaactttaatcagaagagagggtactatcagctccgcggagaggaggaagagacccccaacaaactggtggaatactattcccttaaggtggagaaagtcgaagatagcggcgagagaaaggggaaagacacatggtacaatgtgcacctggagaacggaatgatctatcggcgcacctctaatattcctctcgattgggaaggcaagacgaaggagttcatcgttaccacagacctggaagccgatgggtcccccaaaaaggacaaagagggaaacattaagagatcctttcgggcgcctaaagacgatgactggacccttatcaagaagaaaacagaagccgatatcgacaagattaaaatgaccgtgggcgcttacatctatgatacgctgctccaaaagccggaccagaaaattagaggcaagctggtccgcacaatcgagcggaagtactacaaaaacgagctgtatcagattctcaagacccagtctgagttccacgaagaactgagagataaacaactttacatcgcctgcctgaatgagctctatcccaacaatgaacctcgccggaactccatcagcacaagagacttttgtcatctgttcattgaggatatcattttctaccagcgcccccttaagtctaaaaagtccctgatcgacaattgcccttatgaggaaaaccggtacattgataaggagagcggggaaatcaaacacgcttccattaagtgtatcgccaaatctcatcccctctatcaggagttcagactgtggcagttcatcgtgaatctgcgcatttaccggaaggagaccgacgttgacgtgacccaagaactcctgccgacagaggcggattacgtcacgctttttgaatggctgaacgagaaaaaggaaatcgaccagaaagccttctttaagtatcctcccttcggatttaagaaaaccacaagcaattacagatggaactatgtggaggataagccttacccctgcaatgagacccacgctcagattatcgcccgcctcggcaaagctcacattcccaaggccttcctgtccaaagaaaaggaggaaacactgtggcatatcctttatagcatcgaggacaagcaagaaattgagaaagccctccactcttttgctaacaagaataacctgtccgaggagttcatcgaacagtttaaaaatttccctccgtttaagaaagaatacgggagctattctgcgaaggccattaagaaactgctccccctgatgcggatgggaaagtactggagcatcgagaacattgataacggcaccagaatccggatcaataaaattatcgacggggaatacgatgagaacattcgcgagagagtgcggcagaaggctatcaatcttacggacattacacatttcagagccctgcctctctggctggcctgttatctggtctacgatcgccactccgaagttaaagacatcgtgaagtggaagacccccaaagatatcgacctttatctcaagtcttttaaacagcatagcctgcggaaccctattgtggagcaagtcatcaccgaaacactgagaaccgtgcgcgatatttggcagcaggttggacacatcgacgagattcacatcgagctcggcagagaaatgaagaatcccgctgacaaacgggcccgcatgtcccagcaaatgattaagaacgagaatacaaacctgagaatcaaagcgcttctgacggaatttctcaatccggagttcggcatcgaaaacgtgcggccttacagcccctctcagcaggatctgctgcgcatttatgaggagggggtccttaattccatcctcgaactgcctgaggacattggaatcattctgggcaagtttaaccagaccgatacactcaagagacccacccggagcgaaatcctgcgctacaaactttggctggagcaaaagtatagatctccttacacaggggaaatgatccccctctccaaactgttcaccccggcttacgagattgagcatatcattcctcagagccggtattttgacgattccctgtctaataaggtgatctgcgaaagcgagattaacaaacttaaggaccgctccctcggatacgagttcatcaagaatcaccatggcgaaaaagttgaactggcctttgataagcccgtggaggtcctgtctgtggaggcctatgaaaaactcgtccacgagagctactcccacaacagaagcaagatgaaaaagctgcttatggaagacatccccgatcagttcattgagcggcagctgaacgactctagatatatctccaaggtggttaaaagcctcctgtctaatattgtgcgcgaggaaaacgagcaagaagctatctccaagaatgtcattccttgtaccgggggcatcacggatcggctgaaaaaggactggggaattaacgatgtgtggaataaaatcgttcttccgagatttatccgcctgaacgagctcacagaaagcacccggttcacatctattaataccaacaatacgatgatccccagcatgcctctggagctccagaagggctttaacaagaaaagaattgaccatcgccaccatgccatggacgctatcattatcgcctgcgcgaatcggaacatcgtgaattacctgaacaatgtctccgccagcaagaacacaaaaattaccagacgcgatcttcagacactgctctgtcacaaggacaaaaccgataacaatgggaactataagtgggtgatcgacaagccctgggagaccttcacacaagatacgctgaccgctctgcagaaaattacagtgtcttttaagcagaatcttcgggttatcaacaaaaccacaaatcattaccagcactacgaaaacggaaagaaaattgtctccaatcaaagcaagggcgactcctgggccatcagaaaatctatgcacaaggagaccgtgcatggggaagtgaacctgcggatgatcaagacggtcagcttcaatgaggctctcaaaaagcctcaggccattgtggaaatggatctgaaaaagaaaatcctcgcgatgctggagcttggatatgacacaaagcgcattaagaactactttgaggaaaataaagatacctggcaggacatcaacccctccaagattaaagtttattacttcaccaaggagacaaaagatagatatttcgccgtgcggaagcctatcgacacctcttttgacaagaaaaagattaaagaaagcatcacagatacgggcatccagcaaattatgctgcgccacctcgagaccaaggacaatgatcccacactggctttctccccggacgggatcgatgaaatgaacagaaatattctgatccttaacaaaggcaagaagcatcagcctatttacaaagtccgggtgtatgagaaggccgagaaatttaccgttggacagaagggcaataaaagaacaaagttcgtggaagctgccaaagggaccaacctgtttttcgccatctacgagacggaagagatcgacaaggataccaagaaagtcattcgcaagcggtcttacagcacaatccccctcaacgtggttattgagagacagaaacaaggactgtccagcgctcctgaagacgagaatggcaacctccccaagtatatcctgtctccgaatgatcttgtgtacgtccctacccaggaagagattaacaaaggggaagtggtgatgcccatcgaccgcgatcggatctataagatggtcgactccagcggaattacagcgaattttatccctgcctctaccgctaacctgattttcgccctgcccaaggccacagctgagatctactgcaatggcgagaactgcattcagaatgaatatgggatcggcagcccccaaagcaaaaaccagaaggccattaccggagagatggttaaagaaatctgttttcctatcaaggtggatagactcggcaatattatccaggtggggtcttgcattctgacgaactga

SEQ ID NO: 4597 - RNA, 4563 nt, synthetic construct
  misc_feature 1..4563: note = Cas9 variant
  source 1..4563: mol_type = other RNA
atgaagaaaatcgtgggcctggacctcgggaccaacagcattggatgggccctgatcaatgcttacattgatgagtataacaaggaacacctttacggcatcgaggcctgcgggtccagaattatccccatggacgcggctatcctgggaaatttcgataaaggcaactctattagccagacagccgaccggacgtcctatcgcgggatcagacggctccgcgaaagacatctgcttcggcgcgagagactgcaccggattctcgatctgctgggatttctccctaagcattactctgacagcctgaatcgctatggcaaattccttaacgatatcgaatgtaagctgccgtgggtcaaggacgagaccggctcctacaaatttattttccaagagtcttttaaggaaatgctcgccaatttcacagagcaccatcccatcctgattgctaacaataaaaaggttccttatgattggaccatctactaccttcggaaaaaggccctgacacagaagatcagcaaagaggaactcgcttggattctgctgaactttaatcagaagagagggtattaccagctccgcggagaggaagaggaaacccccaacaaactggtggagtattactcccttaaggtggaaaaagtcgaggacagcggcgagagaaaggggaaagatacatggtataatgtgcacctggaaaacggaatgatctaccggcgcacctctaatattcctctcgactgggagggcaagacgaaggaatttatcgttaccacagatctggaggccgacgggtcccccaaaaaggacaaagaaggaaacattaagagatcctttcgggcgcctaaagatgacgattggacccttatcaagaagaaaacagaggccgacatcgataagattaaaatgaccgtgggcgcttatatctacgacacgctgctccaaaagccggatcagaaaattagaggcaagctggtccgcacaatcgagcggaagtactataaaaacgaactgtaccagattctcaagacccagtctgagttccacgaggaactgagagacaaacaactttatatcgcctgcctgaatgaactctaccccaacaatgagcctcgccggaactccatcagcacaagagatttttgtcatctgttcattgaggacatcattttctatcagcgcccccttaagtctaaaaagtccctgatcgataattgcccttacgaagagaaccggtatattgacaaggaaagcggggagatcaaacacgcttccattaagtgtatcgccaaatctcatcccctctaccaggagttcagactgtggcagttcatcgtgaatctgcgcatttaccggaaggaaaccgacgttgatgtgacccaagagctcctgccgacagaagcggactatgtcacgctttttgagtggctgaacgagaaaaaggaaatcgatcagaaagccttctttaagtaccctcccttcggatttaagaaaaccacaagcaattatagatggaactacgtggaggacaagccttatccctgcaatgaaacccacgctcagattatcgcccgcctcggcaaagctcacattcccaaggccttcctgtccaaagagaaggaagagacactgtggcatatcctttacagcatcgaagataagcaagagattgagaaagccctccactcttttgctaacaagaataacctgtccgaagagttcatcgaacagtttaaaaatttccctccgtttaagaaagagtatgggagctactctgcgaaggccattaagaaactgctccccctgatgcggatgggaaagtactggagcatcgaaaacattgacaacggcaccagaatccggatcaataaaattatcgatggggagtatgacgagaacattcgcgaaagagtgcggcagaaggctatcaatcttacggatattacacatttcagagccctgcctctctggctggcctgttacctggtctatgaccgccactccgaggttaaagatatcgtgaagtggaagatccccaaagacattgatctttacctcaagtcttttaaacagcatagcctgcggaaccctatcgtggaacaagtcattaccgagaccctgagaacagtgcgcgacatctggcagcaggttggacacattgacgagatccacattgaactcggcagagagatgaagaatcccgctgataaacgggcccgcatgtcccagcaaatgatcaagaacgaaaataccaacctgagaatcaaagcgcttctgacagagttcctcaatccggagttcggcattgaaaacgtgcggccttatagcccctctcagcaggacctgctgcgcatctacgaggaaggggtccttaattccattctcgagctgcctgaagatatcggaattatcctgggcaagtttaaccagacggacaccctcaagagacccacacggagcgagatcctgcgctataaactttggctggaacaaaagtacagatctccttacaccggggagatgattcccctctccaaactgttcacaccggcttatgagatcgaacatattatccctcagagccggtactttgatgactccctgtctaataaggtgatttgcgagagcgaaatcaacaaacttaaggatcgctccctcggatatgagttcatcaagaatcaccatggcgaaaaagttgagctggcctttgacaagcccgtggaggtcctgtctgtggaagcctacgagaaactcgtccacgaaagctattcccacaacagaagcaagatgaaaaagctgcttatggaggatattcccgaccagttcatcgagcggcagctgaacgattctagatacatttccaaggtggttaaaagcctcctgtctaatatcgtgcgcgaagagaacgaacaagaggctatttccaagaatgtcatcccttgtaccgggggcattacggaccggctgaaaaaggattggggaatcaacgacgtgtggaataaaatcgttcttccgagatttattcgcctgaacgaactcaccgagagcacacggttcacctctatcaatacaaacaataccatgattcccagcatgcctctggagctccagaagggctttaacaagaaaagaatcgaccatcgccaccatgccatggatgctattatcatcgcctgcgcgaatcggaacattgtgaattatctgaacaatgtctccgccagcaagaacacgaaaatcacaagacgcgaccttcagaccctgctctgtcacaaggataaaacagacaacaatgggaactacaagtgggtgattgataagccctgggaaaccttcacccaagacacactgacggctctgcagaaaatcaccgtgtcttttaagcagaatcttcgggttattaacaaaacaaccaatcattaccagcactatgagaacggaaagaaaatcgtctccaatcaaagcaagggcgattcctgggccatcagaaaatctatgcacaaggaaacagtgcatggggaggtgaacctgcggatgattaagaccgtcagcttcaatgaagctctcaaaaagcctcacgccatcgtggagatggacctgaaaaagaaaattctcgcgatgctggagcttggatacgatacgaagcgcatcaagaactattttgaagagaataaagacacatggcaggatattaacccctccaagatcaaagtttactatttcaccaaggaaaccaaagacagatacttcgccgtgcggaagcctattgacacatcttttgataagaaaaagatcaaagagagcatcaccgacacaggcattcagcagatcatgctgcgccatctcgaaacgaaggataatgaccccaccctggctttctccccggatgggattgacgagatgaacagaaatatcctgattcttaacaaaggcaagaagcaccaacctatctataaagtccgggtgtacgagaaggccgaaaaatttacagttggacagaagggcaataaaagaaccaagttcgtggaggctgccaaagggacaaacctgtttttcgccatctacgaaaccgaggagattgataaggacacgaagaaagtcatccgcaagcggtcttatagcaccattcccctcaacgtggttatcgaaagacagaaacagggactgtccagcgctcctgaggatgaaaatggcaacctccccaagtacattctgtctccgaatgaccttgtgtatgtccctacacaagaggaaatcaacaaaggggaggtggtgatgcccatcgatcgcgaccggatttacaagatggtcgattccagcggaatcaccgcgaattttattcctgcctctacagctaacctgatcttcgccctgcccaaggccaccgctgagatttattgcaatggcgaaaactgcatccagaatgagtacgggattggcagcccccagagcaaaaaccaaaaggccatcacaggagaaatggttaaagagatctgttttcctattaaggtggacagactcggcaatatcattcaggtggggtcttgcatcctgaccaactga

SEQ ID NO: 4598 - RNA, 4563 nt, synthetic construct
  misc_feature 1..4563: note = Cas9 variant
  source 1..4563: mol_type = other RNA
atgaagaaaatcgtgggcctggacctcgggaccaacagcattggatgggccctgatcaatgcttacattgatgagtataacaaggaacacctttacggcatcgaggcctgcgggtccagaattatccccatggacgcggctatcctgggaaatttcgataaaggcaactctattagccagacagccgaccggacgtcctatcgcgggatcagacggctccgcgaaagacatctgcttcggcgcgagagactgcaccggattctcgatctgctgggatttctccctaagcattactctgacagcctgaatcgctatggcaaattccttaacgatatcgaatgtaagctgccgtgggtcaaggacgagaccggctcctacaaatttattttccaagagtcttttaaggaaatgctcgccaatttcacagagcaccatcccatcctgattgctaacaataaaaaggttccttatgattggaccatctactaccttcggaaaaaggccctgacacagaagatcagcaaagaagaactcgcttggattctgctgaactttaatcagaagcgggggtattaccagctccgcggagaggaagaggaaacccccaacaaactggtggagtattactcccttaaggtggaaaaagtcgaggacagcggcgagaagaaagggaaggatacatggtataatgtgcacctggaaaacggaatgatctacagacggacctctaatattcctctcgactgggagggcaagacgaaagagttcatcgttaccacagatctggaggccgacgggtcccccaagaaagacaaggaaggaaacattaaacgcagctttagagcgcctaaggatgacgattggacccttatcaagaaaaagacagaggccgacatcgataaaattaagatgaccgtgggcgcttatatctacgacacgctgctccaaaaaccggatcagaagattcggggcaagctggtcagaacaatcgagcgcaaatactataagaacgaactgtaccagattctcaaaacccagtctgagttccacgaggaactgcgggacaagcaactttatatcgcctgcctgaatgaactctaccccaacaatgagcctagacgcaactccatcagcacacgggatttttgtcatctgttcattgaggacatcattttctatcagagaccccttaaatctaagaagtccctgatcgataattgcccttacgaagagaaccgctatattgacaaagaaagcggggagatcaagcacgcttccattaaatgtatcgccaagtctcatcccctctaccaggagttccggctgtggcagttcatcgtgaatctgagaatttaccgcaaagaaaccgacgttgatgtgacccaagagctcctgccgacagaagcggactatgtcacgctttttgagtggctgaacgaaaagaaagagatcgatcagaaggccttctttaagtaccctcccttcggatttaaaaagaccacaagcaattatcggtggaactacgtggaggacaaaccttatccctgcaatgaaacccacgctcagattatcacaagactcggcaaggcccacattcccaaggctttcctgtccaaggagaaggaagagaccctgtggcatatcctttacagcatcgaagataaacaagagattgagaaggccctccactcttttgccaacaaaaataacctgtccgaagagttcatcgaacagtttaagaatttccctccgtttaaaaaggagtatgggagctactctgctaaggcgattaaaaagctgctccccctgatgcgcatgggaaaatactggagcatcaagaacattgacaacggcacgcggatcagaatcaataaaattatcgatggggaatatgacgagaacattcgggagcgcgtgagacagaaggccatcaatcttacagatattacccatttccgggctctgcctctctggctggcctgttacctggtctatgacagacactccgaagttaaggatatcgtgaaatggaagacccccaaagacatcgatctttacctcaagtcttttaaacagcatagcctgcgcaaccctattgtggagcaagtcatcacagaaaccctgcggacagtgagagacatttggcagcaggttggacacatcgacgagattcacatcgagctcggccgcgaaatgaagtcccccgccgataaaagagctcggatgagccagcaaatgattaagaatgagaacacgaatctgcgcatcaaggcccttctgaccgaatttctcaacccggagttcggcatcgaaaatgtgagaccttattctccctcccagcaggacctgctgcggatttacgaggagggggtccttaacagcatcctcgaactgcctgaggatattggaatcattctgggcaaatttaatcagacagacaccctcaagcgccccacaagatctgaaatcctgcggtataaactttggctggagcaaaagtaccgctccccttacaccggggaaatgatccccctcagcaaactgttcacgccggcgtatgagattgagcatatcattcctcagtccagatactttgatgactctctgagcaacaaggtgatctgcgaatccgagattaataaacttaaagatcggtctctcggatatgagttcatcaagaaccaccatggcgaaaaagttgaactggcttttgacaagcccgtggaggtcctgagcgtggaggcctacgaaaaactcgtccacgagtcctatagccacaatcgctctaagatgaagaaactgcttatggaagatatccccgaccagttcattgagagacagctgaacgattcccggtacatcagcaaggtggttaaatctctcctgtccaacattgtgagagaggaaaatgagcaagaagccatcagcaagaacgtcattccttgtaccgggggcatcacagaccgcctgaaaaaggattggggaattaatgacgtgtggaacaagatcgttcttccgcggtttatcagactgaatgagctcaccgaatctacacgcttcaccagcattaacacgaataacacaatgatcccctccatgcctctggagctccagaaaggctttaataagaaacggattgaccatagacaccatgctatggatgccatcattatcgcttgcgccaaccgcaatatcgtgaactatctgaataacgtcagcgcgtctaagaataccaaaattacacggagagaccttcagaccctgctctgtcacaaggataagaccgacaacaacgggaattacaaatgggtgatcgataagccctgggagacattcacgcaagacaccctgacagccctgcagaaaattaccgtgtcctttaagcagaaccttcgcgttatcaataaaacaaccaaccattaccagcactatgaaaatggaaagaaaattgtcagcaaccaatccaagggcgattcttgggctatcagaaagagcatgcacaaagagacggtgcatggggaagtgaatctgagaatgatcaagacagtctccctcaacgaggccctgaaaaagcctcaggctattgtggaaatggacctcaaaaagaagatcctggccatgcttgagctgggatacgataccaaacggattaagaattatttcgaggaaaacaaagacacctggcaggatatcaatccctctaagattaaagtttactattttacaaaggagaccaaggaccgctacttcgcggtgagaaaacctatcgacacgagcttcgataagaaaaagattaaagaatccatcacagacaccggcatccagcaaattatgctccggcacctggagacaaaggataacgaccccaccctggccttttctccggatgggatcgacgaaatgaatcgcaacattcttatcctgaataagggcaaaaagcatcagcctatttataaagtcagagtgtacgagaaggctgagaaattcacagttggacagaagggcaacaaacggaccaagtttgtggaagccgctaaggggacgaatctcttctttgccatctacgagaccgaagagatcgataaagacacaaagaaagtcattagaaagcgcagctattccaccatccccctgaacgtggttattgagcggcagaaacaaggactcagctctgcccctgaagatgagaacggcaatctgcccaagtacatcctttccccgaacgacctggtgtatgtccctacacaggaagagattaataagggggaagtggtgatgcccatcgatagagaccgcatctacaaaatggtcgatagctctggaattaccgctaacttcatccctgcgtccacagccaatctgatttttgctctccccaaggccaccgccgagatctattgcaacggcgagaattgcattcagaacgaatacgggatcggcagcccccaatctaaaaatcagaaggctattacgggagagatggttaaagaaatctgtttccctatcaaggtggaccggctgggcaacattatccaggtggggtcctgcattcttacaaattga

SEQ ID NO: 4599 - RNA, 4575 nt, synthetic construct
  misc_feature 1..4575: note = Cas9 variant
  source 1..4575: mol_type = other RNA
atgaacaagatcctgggcctcgacctggggaccaatagcattggatgggccatcgtgcagaaagatgagcaaggcttctacgaaaagattatcaacgctgggtccagaattatccccatggacgccgagacaatgaataactttaataaaggaatcacgaagtctcctgcgagcgaacggacccgcttcagaggcgctcggcgccttattgagagatccctgctccggcgcgaaagaatccaccggctgcttaacacaatgaattatctgccgccccattacgccgagaaaattgattttgtcaaccgcctcgggaagttcatcggagaggaggaacctaagtatgcctacaaagttgacgaacacggcaagtttcagttcatttttaaagagtctttcaatgagatgctgaaggattttcaggacaaacagcccgaactggtgctcaacaataagaaggtgccttatgattggaccatctactatctgagaaagaaggctcttaaccgggccattagcaaagaggaactgggctggatcatcctccaattcaataacaagcgcgggtactaccagctgagaggagaggaagacgagacacttaccgagggccagaaaaaggaatattttgctctgaaagtcattcgggtggaggccgattcctctagcgcggggaagaagggagaagtttggtacaatgtgcagctcgagaacggctggatctatcgctgcaaatccgaaattcccctggactgggaggggaagatcaaagagttcattgtcacaaccgaagtggatgagaacgacaatgttctgaaggataaagaaggaaaggagaagagaaaactcaagatccctgaagccggcgactggacgctgcttaaaaagaaaaccgagagcgacctggataagtctggcaagacagtgggggcttacatctatgacaccctcctgtccaacccggatcagaaaattaagggaggccttatccggacaattgagagagaactgtaccgcagcgagctcgaacaaatcctggacaaacagaaggagtttcatcccgagctgaaagatgggaccctctataataagtgtgtcgaggaactgtaccggtctaacgaatccagacgcattagcctttctaattacgacttcacgcggttcatcacagaggatgtgatcttttatcagagacctctgaagtccaaaaagagcctcattgacaactgctccttcgaacgccggaattacctgaaccccatcaccaaagagcttgcctatgctcctattaagtgtatcgccaaatctcaccccctgtttcaagagttcagactctggcagtttattaagaatctgcgcatcattgaacgggagaaaatcgtgggagataagctgatgttcgaccaggatgtcacaaccgaatttctcccgacccaaaacgactacgttatcctgttcgactggcttaatgagcataaggaaattgatcagaaagcgctgctcaagtatcctgcctttaacctgaaaaagaatatcgacaaatacagatggaactatgtggagaataagagctacccctgcaacgagacacgcgctctgcttaaggccaaactcaacaaggctggcaatattccttccgatttcctggacaacgatacgctggaaagcctctggcacatcctgtactctgtggaggacaaatttgaaattgagaaggcccttaaatccttcgccaccaagaaggaactgcgggaggagcagacagtcgcttttgtgaaacagttcatcaatatccctcccttcaagaaagaatatgggagctactctgcgaaggccattaaaaagctcctgcaactgatgagaatgggaagccggtggtccgagaacgaaatctctgatagcaccaaggaccgcattcagaaacttatcgatggcgagtgggacgagtccattaagacaagaacccgggataaagctatcaagctcaatgaaatcaacgactttcagggcctgcccctgtggctcgccagctatattgtttacgatagacactctgagtccggggacgtgatgaaatgggaaacgccggaggacatcgattattacctgaagcatgtcttcaaacagcacggacttcgcaatcccattgtggaagttgtggtcgtggagacactgaaggtcgtgaaggacctctggaaaacctatggctactttaacgagatccatattgaactggggcgggagatgaagaatcctgccgataaaagacgcagcatgaccaacaagaatatcgaaaacgagaatacaaacctgagaatcaaagcccttctcgctgaactggcgaatcacaaggacgttgagggagtgcggccctactctccttcccaacaggagattctgaagatctatgaagagggcgtcctcgatatgctgaccaaagaagaccccgattacgagagcatttccaagatctctaaaatggcccttccgagctcctctgaactgattcgctataagtgttggctcgagcagaaatacagaagcccttatacaggacaggtgatccccctggctcggctgttcacgtccgagtacgaaattgagcacatcatccctcaaagccgctattttgacgattctttctccaacaaggttatttgcgaaagcgccgtgaacaaggacaaagataatcttctcgcttacgagtacatcaagcagaacgagggcaaaattatcgaaattggactgggcaagaaagtcaagctgtttaccgccgactcttatacagagttcgtgcagtccaattacgtggggagcgttgctaagaaaaagaaactcctgatggataccatccccgactcttttatcaagagacagcttaacgacagccggtatatttcccgcgaaatcatgaaactgctcagctctgtcgtgagagagaaggaagaggaggaagaggaagaggaagaggaggccatttccaagaatgtgatcgtctgtacaggagcgattaccgataaactgaagcgggaatggggcctgaacgacgtgtggaatacgatcatctaccctcgcttcgagagacttaaccaactgaccaatagcgataaatttgggcagtgggaaaacaagcaggggaaaaaggttttccaaattgagatgcccctcaaactgcagaagggctttaataagaaacggatcgaccatagacaccatgccatggatgctattgtgatcgcctgcgctacacagtcccacgtcaactatctcaataacgaatctgcccatagcaattccaaggagaaacgctactatctgcggagaaaacttcgccggattgagatcctggaaaaacaggagctcaaggacggggtgaccattacaaagaaaatcgaagttgcgaaggagttcaacaaaccgtggcctaccttcacgcaagatgcccacgaggtgctgcagtctatcattgtcagctttaagcagaacctgagagtggttaataaagctacaaaccgctacgcctgtttcgtgaatggcaagaaggaaatcgtcaaacagtccaagggagagtcttgggctattcggaaacccatgcacaaggacaccgtgagcgccgccgtgtcccttagaaaaatcaagacagtcagcctgtctcaagctattgatgactggaccaacatcgttgataagtccctccgcaaagaaatcggcctgctctacagcaagtatgggcagaatggatctaaaaacattatcaagtactttaaagaccgggacaataagcataacggcctggatgtgtccaaagtgaatgtccactatttcgacaacgattacgcggccagcagagtggctcttgaccataagtttaattctgccaagattaaatccatcaccgatacagggattcagacgatcctgctcaagcacctggagagctataacgaaatcaatggagacaaaattatcgagcaccccgagctggccttctccgctgatggccttgacattctgaacgccaatatcaccaagctcaacaatgggaaatttcataagcctattaagaaagttcggaagacagaaaccctgggcctcaaattcatcgtgggacagacaggcaacaagcgcaaaaagtacgtcgaggcggctgatgggaccaacctgtttttcgccatttatgtgagcgttgacggaatcagatcttacaagacgatcccgcttcgggaagtggccgagcgcctgaaagaaggcctgattcccgtccctgagaagaatgataaagacgatcacctcctgttttggcttagccccggggacctggtgtacgttccttccatcgaggaagagggaagaattgtggaaatcgagaacattaagcaagaccggatctataaagtcgtgtcttgcacagaaaatgagtgtcattgcatcccccacttcgtggctagccctattgtcaagaccgatgagctcggcgccaacaataaggcgcagagagcttggtccggggaaatgatcaaagagacctgcattaagatcaaaatgaaccgcctgggccagattgttaagatctga

SEQ ID NO: 4600 - RNA, 4581 nt, synthetic construct
  misc_feature 1..4581: note = Cas9 variant
  source 1..4581: mol_type = other RNA
atgaagaaaatcctgggcctcgacctggggaccaacagcattggatgggccgtgcttaatgctgccgatgacaactccctgaagtacatcgaggcggctggctctagaattatccccatggatgccgccattctcggggacttcgatcggggaaatagcatctcccagacagctgaacgcacgagaatccggggcatgcgccacctgagagagcggtatcttctgcgcagagcccggctccatcgcattctgaacctgctcgggtttctgcctttccactacgctcaagacatcgatagatatggaaatttttctgccgacatggaaccgaaaattgcgtggcggaagaaccttgagggcgaactggagttcatctttattgagagcttcaatgaaatgctcgaggattttcgcaaaaaccagcccgaactggtcgccgacaataagaaggttccttacgattgggtgatctattaccttagaaagaaggctctggagaaaaagatttccaaagaggaactcgcctggatcctgctgaacttcaatcagaagcggggctattaccagctccgcggggaggacgatgacgaatctatgaagaccgctaaaacaagacaatactttgacaagcagatcattaaaaacatcattgataccaatcagacatataagggacagcggatcctgattgtggagcttcaaaacggcgacaaagggaagatcttcaaaaaggaaatccccgattggattggacaggagaagaatatcattgtcaccgtggacatcgataaagacggcaacgataagtacgaggaaagcgggtccctgagctgcagatttaaaattcctacagacgccgagtgggaatctgagtggaagctcatcaaaatgaagacccagaaggatctggacgaatccaacaaaacggttggaacctatatctacgatagcattcttcagaatcccacacaaaaggtgcgcggcaaactggtccggaccatcgagagaaagtattacaaagcggagctcaagcagattctggaaaagcagacagagttccattctgaactgcaagacaaagacctctatatcgagtgtctgaacgaactttactccaataacgatacccaccgcaatgccattacggaccgggattttgtgtacctgttcatgaacgacatcctcttctatcagagacctctgaagtccaaaaagtctcttattgataattgcccgtacgagcgcaacatctatatcgacaaagagacaggcgaaattaagtactcccccatcaagtgtattgctaaaagccatcctctgtttcaggagttccggctctggaagtttatctcctctattagaatctatcagcgcgaaagcgttgtggaggtcgtggataaacaactggacctgttctccagccagtctacctccgtgcagaagctcgtcacagatgttgacgtgaccgataaatttctgacctgcgagaatgactacgtggcccttttcgaatggctgaacaagaaaaagatcattgatcagaaggagtttctcaaatatcggcccttcgggctgaagggagacatcgacaattacagatggaactacgtcgaagataaaagctatccttgtaatgagacacacgctatgattctgacgtactttgccaaggccggcatctctgaagacattcttaccaaagagatggaggaagctctctggcacatcctgtatagcgtggaggatcgccaagaaatcacaaaggcgctgcggaccttcgcctccaagtaccatctctctgacagctttgttaaagtgttctccaacattcccccgtttaagaaagagtatgggagctactctgctaaggccatcaaaaagctgctttccctgatgagaatgggaaagtattggagcgaagatgccattgacgtcaatacacgggagcgcatcgataaaattgtgaccggcgagtacgacgaaaagatcagagatcgggttagagagaaaacgatccgcctcaacgacattcggcacttcagagctctgcctgattggctggcctgctacgtggtctatgaccgccattctgaaacaagagagatcaccgaatggaagtcccccgaggagattgatgaatacatccggaacttcaaacagcacagccttcgcaatcctattgtggagcaggtcatcaccgaaacactcagaaccgtgcgggacatttggaagcaggttgggtgtatcgacgagatccacgtggagctgggacgcgaaatgaagaaccccgcggataaaagaaagcggattacatcccaaatcattgagaatgaaaacgctaatctgcgcgtcaaagccctcctgacggagtttgtgaaccccgagttcgagatcgagaatgttagaccttattctcttggccagcaggacattctgcggatctacgaagatggcgtgctcaacagcgtcgccgaggtgccgggggacatcgctggcattctgaagaaatttaatgaaaacgatgccaagaaacgccccaccacatccgagatcctgagatataaactttggctcgaacagaagtaccggtctccttataccggagagatgattcccctgagcaaactgttcacatccgcttacgagatcgaacatgtgattcctcaaagcagatactttgacgattctttctccaataaggttatctgcgaggccgaagtcaacaaactcaaggacaatgcgctggggtatgagtttatcaaaaagcaccatggagaaaaggtggagcttggcttcgggaaaattgtggagatctttagcgtctctgtgtacgaacagttcgttaaggataactattcccgcaatcggggcaaaatgaagaaactgctcatggacgagattcccgaacagtttatcgagagacaactgaacgatagccgctacatttctaaggtggtcaagaccctgcttagcaacgtggttcgggagaaagccgaacaggaggctgtgtccaagaatgtcatcgtgtgtacgggaggcgttaccgacagactcaaaaaggactgggggattaacgatgtgtggaataaaatcgtcctgccgcgcttcctgcggctcaacgaactgacaaatagcaccaactttacagccaagaatgctgccggaaacgagatccctgcgatgccccttgaactgcagaagggcttcaataaaaagagaattgaccaccgccatcacgccatggatgctatcgtgattgcctgcgctaaccggaatatcgtgaactatctcaataacgagtctgcctccagaaaagccaagattagccggcacgacctgcaggctatcctgtgtgataaagtccgcaccgacgataaggggaattaccaatggagagttaagaaaccttgggacacgttcacacaggatgtgtatgtggcgcttgagaacatcattgtctcctttaagcagaacctgcgggtgatcaataaaacctctaactactactggcattatgaaaatggaaagaaagttctcgtgaagcaggtcaaaggcgacagctgggccattcgcaagcccatgcacaaggatacagtgttcggggaggttaacctgagaaaagtgaagtccgtctctctcaatgaagctctgaaaaaccctcaatttatcgtggagaaggaccttaaacggcagctgctcagcctgctgcagcagaatttcgatattaagaagatcaaaaagtactttgaagaacataaagacatctggtccgacatttctcttagcaagatgaacatctattacttcaccaaagagaccaaggatagatattttgccacacgcaagcccctggacgcctccttcgataaaaagaaaattgaaagctgcatcacggacaccggcattcaacagatcctcctgcggcacctcgagctgaaggaaaatgatccggagagagctttttctcctgacggaattgatgaaatgaaccgcaatatcatccagcttaacaaaggcaaggggcaccatcccattgccaaggttcgggtgtacgagaaagcggacaagttcgaggtcggacaaagaggcaataaatccagcaagtttgtggaagctgccaaagggacaaacctgttcttcgccgtgtatgagaccgaataccccgatgagaagacaaattctatcgtccgcaaacggaactacgctaccattcctctcaatatcgccattgagagacagaagcgcggactgtccacggcgccggaagacgagaagggcaacgttcccagctttgtgctgtctcctaacgatcttgtgtatctgcccacatccgaagacatcgtcaatgggcacatcacccagcctattgataaaagcagaatctacaagatggtgtccagctctggcagccagtgcttctttattaaacataacatcgctaatattatcgttgacaagtatgagttcagccccctcaacaaaatggaacgggccatctctaatgagatgattaaggagatctgtattcctgtgaaggtcgaccgcctgggaaacatcgtgaaactcggcaagagcgaatga

SEQ ID NO: 4601 - RNA, 4581 nt, synthetic construct
  misc_feature 1..4581: note = Cas9 variant
  source 1..4581: mol_type = other RNA
atgaagaaaatcctgggcctcgacctggggaccaacagcattggatgggccgtgcttaatgctgccgatgacaactccctgaagtacatcgaggcggctggctctagaattatccccatggatgccgccattctcggggacttcgatcggggaaatagcatctcccagacagctgaacgcacgagaatccggggcatgcgccacctgagagagcggtatcttctgcgcagagcccggctccatcgcattctgaacctgctcgggtttctgcctttccactacgctcaagacatcgatagatatggaaatttttctgccgacatggaaccgaaaattgcgtggtgcaagaaccttgagggcgaactggagttcatctttattgagagcttcaatgaaatgctcgaggattttcggaaaaaccagcccgaactggtcgccgacaataagaaggttccttacgattgggtgatctattaccttcgcaaaaaggctctggagaaaaagatttccaaagaggaactcgcctggatcctgctgaacttcaatcagaagagaggctattaccagctccgcggggaggacgatgacgaatctatgaagaccgctaaaacacggcaatactttgacaagcagatcattaaaaacatcattgataccaatcagacatataagggacagagaatcctgattgtggagcttcaaaacggcgacaaagggaagatcttcaaaaaggaaatccccgattggattggacaggagaagaatatcattgtcaccgtggacatcgataaagacggcaacgataagtacgaggaaagcgggtccctgagctgtcggtttaaaattcctacagacgccgagtgggaatctgagtggaagctcatcaaaatgaagacccagaaggatctggacgaatccaacaaaacggttggaacctatatctacgatagcattcttcagaatcccacacaaaaggtgagaggcaaactggtccgcaccatcgagcggaagtattacaaagcggagctcaagcagattctggaaaagcagacagagttccattctgaactgcaagacaaagacctctatatcgagtgcctgaacgaactttactccaataacgatacccacagaaatgccattacggaccgcgattttgtgtacctgttcatgaacgacatcctcttctatcagcggcctcttaagagcaaaaagtctcttattgataattgtccgtacgagagaaacatctatatcgacaaagagacaggcgaaattaagtacctgcccatcaagtgcattgctaaatcccatcctctctttcaggagttccgcctgtggaagtttatcagctccattcggatctatcagagagaatctgttgtggaggtcgtggataaacaactggacctcttcagctcccagagcacctctgtgcagaagctggtcacagatgttgacgtgaccgataaatttcttacctgtgagaatgactacgtggccctgttcgaatggctcaacaagaaaaagatcattgatcagaaggagtttctgaaatatcgccccttcgggctgaagggagacatcgacaattaccggtggaactacgtcgaagataaatcctatccttgcaatgagacacacgctatgattcttacgtactttgccaaggccggcatcagcgaagacattctcaccaaagagatggaggaagctctgtggcacatcctgtattctgtggaggatagacaagaaatcacaaaggcgctccgcaccttcgccagcaagtaccatctgtccgactcttttgttaaagtgttcagcaacattcccccgtttaagaaagagtatgggtcctacagcgctaaggccatcaaaaagctgctgtctctcatgcggatgggaaagtattggtccgaagatgccattgacgtcaatacaagagagcggatcgataaaattgtgaccggcgagtacgacgaaaagatccgcgatagagttcgggagaaaacgatcagactgaacgacattcgccacttccgggctctgcctgattggcttgcctgttacgtggtctatgacagacatagcgaaacacgcgagatcaccgaatggaagtctcccgaggagattgatgaatacatcagaaacttcaaacagcactccctccggaatcctattgtggagcaggtcatcaccgaaacactgcgcaccgtgagagacatttggaagcaggttgggtgcatcgacgagatccacgtggagctgggacgggaaatgaagaaccccgcggataaacgcaagagaattacaagccaaatcattgagaatgaaaacgctaatctccgggtcaaagccctgcttacggagtttgtgaaccccgagttcgagatcgagaatgttcgcccttattccctgtctcagcaggacattctcagaatctacgaagatggcgtgctgaacagcgtcgccgaggtgccgggcgacatcgctgggattctgaagaaatttaatgaaaacgatgccaagaaacggcccaccacatccgagatccttcgctataagctctggctggaacagaagtacagatctccttataccggagagatgattcccctgagcaaactcttcacatccgcttacgagatcgaacatgtgattcctcaaagccggtactttgacgattctttctccaataaggttatctgtgaggccgaagtcaacaaactgaaggacaatgcgcttggctatgagtttatcaaaaagcaccatggggaaaaggtggagctgggattcggcaaaattgtggagatctttagcgtctctgtgtacgaacagttcgttaaggataactattccagaaatcgcgggaaaatgaagaaactcctgatggacgagattcccgaacagtttatcgagcggcaactgaacgatagcagatacatttctaaggtggtcaagacccttctcagcaacgtggttcgcgagaaagccgaacaggaggctgtgtccaagaatgtcatcgtgtgcacgggcggagttaccgaccggctgaaaaaggactggggcattaacgatgtgtggaataaaatcgtcctgccgagattcctccgcctgaacgaacttacaaatagcaccaactttacagccaagaatgctgccgggaacgagatccctgcgatgcccctggaactccagaagggattcaataaaaagcggattgaccacagacatcacgccatggatgctatcgtgattgcctgtgctaaccgcaatatcgtgaactatctgaataacgagtctgcctcccggaaagccaagattagcagacacgacctgcaggctatcctttgcgataaagtccggaccgacgataagggcaattaccaatggcgcgttaagaaaccttgggacacgttcacacaggatgtgtatgtggcgctggagaacatcattgtctcctttaagcagaacctcagagtgatcaataaaacctctaactactactggcattatgaaaatgggaagaaagttctggtgaagcaggtcaaaggagacagctgggccattcggaagcccatgcacaaggatacagtgttcggcgaggttaacctccgcaaagtgaagtccgtctctctgaatgaagctcttaaaaaccctcaatttatcgtggagaaggacctgaaaagacagctcctgagcctgcttcagcagaatttcgatattaagaagatcaaaaagtactttgaagaacataaagacatctggtccgacatttctctgagcaagatgaacatctattacttcaccaaagagaccaaggatcggtattttgccacaagaaagcccctcgacgcctccttcgataaaaagaaaattgaaagctgcatcacggacaccgggattcaacagatcctgctccgccacctggagcttaaggaaaatgatccggagcgggctttttctcctgacggcattgatgaaatgaacagaaatatcatccagctgaacaaaggaaagggccaccatcccattgccaaggttcgcgtgtacgagaaagcggacaagttcgaggtcgggcaacggggaaataaatccagcaagtttgtggaagctgccaaaggcacaaacctcttcttcgccgtgtatgagaccgaataccccgatgagaagacaaattctatcgtcagaaaacgcaactacgctaccattcctctgaatatcgccattgagcggcagaagagagggctgtccacggcgccggaagacgagaagggaaacgttcccagctttgtgctttctcctaacgatctggtgtatctccccacatccgaagacatcgtcaatggccacatcacccagcctattgataaaagccgcatctacaagatggtgtccagctctgggagccagtgtttctttattaaacataacatcgctaatattatcgttgacaagtatgagttctctcccctgaacaaaatggaaagagccatctccaatgagatgattaaggagatctgcattcctgtgaaggtcgaccggctcggcaacatcgtgaaactgggaaagagcgaatga

SEQ ID NO: 4602 - RNA, 4584 nt, synthetic construct
  misc_feature 1..4584: note = Cas9 variant
  source 1..4584: mol_type = other RNA
atggccaagatcctgggcctcgacctggggaccaacagcattggatgggctatcgtggagaaagatggcaatgacttctcccttgtcgataagggggttagaatcttttctgaaggagtgaaaagcgagaagggcattgaatcctctcgggccgcggagcgcacagggtacagaagcgctcggaaaattaagtatcgcagaaagctgcggaaatacgaaacgctcaaggtgctgtcccttaacggaatgtgccccctgtctatcgaggaggtcgaagagtggaaaaagagcggcttcaaagaatatcctctcaatccggagtttctggagtggctgcgcacctccgacgatgaaaacatcaatccctacttctttagagacaaggccagcaagcagaaagtgacactcttcgaggttggccgggccttttatcacattgctcaacgcagagggttcctgtctaaccggcttgatcagtccgccgaaggaatcctggaggaacattgtcctaagattgaggctctcgtggaggacctgaatagcaccgatgaaatccttacatctctgaaagactactttttcgataccggcattctcgacgccaacgagaaagggggatttgcgaaagatctggacgaaggcgacaagaaactggtctccctctatcgcagcatccaggccattgtgaagaagaatgatacagacttcgagaaagggaaggctgaaatcatcgagagactgaacaaaaaggatgttcttggaaaagtgaagggcaagattaaagacatctctcaggccatgctggagggcaattttaagaccctcgggcaatacttcttctccctgtacaacaaagaacggattcgcaatcagtatacgagcagagaggatcactaccttgaagagtttaagatcatttgcaaattccagggaatcggctccatcaaccagaatgaaaagctgcccgagaagaaatttgaggggctcgctaaggaactgtataaagccattttctttcaacggcctctgaagtctcagaaaggactcatcggcaagtgtagcttcgagaagtccaaaagcagatgcgcgatttctcatcccgactttgaagagaagcgcatgtgggagtacctgaacaccatcaaaattgggacacagtccgaaaaggtccttcggttcctgagccaggaggaaaaactcaacctgatccctaagtttcttagaaagaaggataatttcaactttgaggacctggccaaggaactcatcgagaaaggagctaccttcggcttttataagtctagcaaacgcgattccttccactactggttcaattataagccgacagacaccgtgtctggctgtcccgtgagcgcctccctgaaaagcgtcgttggggaggattggaagacgaagtcttttatttacaaaacaaccaactccaagggaatcgaagtgagccggacagtgaattacaaagacctgtggcatctcctgtctgtctccaccagcgacatttatctttacgagtatgctaagaacaaactgggcctcgaagataagaatgccaaggccttctccaaaatcaagctgaaaaaggactttgggaacctgtctcttaatgctattaacaaaatcctcccttacatgagagagggactgctgtatagccacgcggtgttcatggccaatattgaatccatcgttgatgaggtgatctggaacgacctcggccaacgcaagtacattcaggataagatcgctgccattatcgccaataacattgtcgacaatgggctgcttgaggtggttaacggcctgatcaaagaatgcaaggtggatggagcttattactctaaagaggccgcggacacctaccggaaggatctcagcaaaaagctggtctcctttttcaaatttcaccatatcgacgatggcattaagcaggaaacaatcctgaacgagcttttccccgtgtttattgaacaactcaaggctcacgagttcatcaaagtcaagagactggacgagaaagtgctggaatttctcaagggggagaatcaggatggagaagttttctgtaacaatgccaaacagctgaagaaactttatcatcctagcgacattgaggtgtttaaaaagcagatcgtcaaagacaaggatggcacggagaccgggcaactgatcctcggatctcccctgacatccagcattaaaaacccgatggccatgcgcgctctgcaccagcttcggaaggtgctcaataccctgatcgttgaagaacaggtggactcttccacacgcattcacatcgagatggccagagagctgaacgatgctaataagcggaaaggcattcaggactaccaaaacgaaaataagaaagagagagagaagtatcgggatgaaatcaaaaagctctacctggccgagtgcaacaaggaaatcgagcctaccgtcgacgatcttctgcgctatcagctctggattgaacaggacagaaaagagatctacgagaatgggaacagcatttctatctgtgatattatcggcgacaatcccgcgtatgatattgaacatacggtgcctcggagcatctcccaggacaacagccaaatgaataagacactgtgctctcagaaattcaacagagatgtgaagaaacagaagatgcccttcgagctgggaaaccaccttgaaatcctcccccgcattgcccattggaaggaggaagctgacaatctgtcccgggagatcgagatgattatcagaagcaccaaaaccgccgctacaaaggaagccaaagacaagaaaattcgcagacggcactacctgaccctccgcagagattacctgcagggcaagtatgaccggtttatctggacagagcctaaagttgggttcaagaactcccaaatcccggatacgggaattatcacccgctacgcgcaggcctatcttaagtcttactttaatagagtcgaaagcgtgaaaggcgggatggtggctgagttccggaagatttggggaatccaggagtcctatcaagaaaacggcaaaaagtactttaaagagaaggaccgctctaagcatacacaccacaccattgatgccatcacaatcgcttgtatgaccaaagacaagtatgatgtcctggcccatgcctggacgctcgaagacaaagagcagattaccgaagctagaaagatcgtggcggagagcaaaccctggaagacattcaaggaggatctgaaaaagattgaagaggggatcctggtttcccactacacccctgacaatgtgaaaaagcagtctaaaaagattgtccgggtgcgcggcagaaagcagtacgttgccgaaatcgagcgggatgtgaacggaaaagctgtcgccaagaaagacattagcggcaaggtgatctataaacttgacaaggatgggaaaaagctgcccagactccaacagggagacacaatccgcggctccctgcatcaggatagcatttacggggccatcaagaatcctctcaaaaccgaagagattcggtatgttatcagaaaggacctggagtctattaaggcttccgatgtggacaacatcgtcgatgaaatggtgaaggagaaagtgaaggaagccatcgcgagcaaggtccttattctgtcttccaatccccagcagaaaaacaagatcgacggaaaagtttggatgaatgaggaaaagggcattccgatcaacaaagtgcgcctctacgctaatagcgtgaagaaccctctggagattaaggagcactcttccctgagcaaatcccggcacgaacataagcaaaaagtctatgggcagaatgatgagaactttgccatggccatctacgaaggccttgacaagaaaggaaagacggagagagctttcgagctgatcaactatatggatgccggctactactataagctcaaaaataagaacgaacgcaaaaaggacattatcagcctggtgcccgagaaacacattgaaacagggtttaatctcctgcggtctaacaagatccctattatccttaaaaagggactgaatgttattctctacaagaacgagaaagaagagatcgatttcaataaccccaatagcatcattaagagactgtataaaatctccggcctggacaaggacgggattaaacttatgtactgcatctctgcgaagggaagcaccgagaacattgcttatatgaatgatgtgatcaacaagcagaaactgtttgaactcaagtccgagatggaaaaactgggcctctgggacaaggtcttctctgatttcaaaaatgacaacctgaaaaagagcgactttttcaagaaacttaatgatctgctgaacaagcattactttgagaataacgtgtgcgattccatcggctctattaagaaagttaagatcaaggaaagcgggctcacaacccctaaaggaggcgacgtgattgataacttcaaggactttccctatatcaaattcaaggtctccaattttaacgccctgattgaggggatcgatttcaaaatcagcccgaccggaaagtttgtgcaaatttga

SEQ ID NO: 4603 - RNA, 4587 nt, synthetic construct
  misc_feature 1..4587: note = Cas9 variant
  source 1..4587: mol_type = other RNA
atgaagaaaatcctgggcctcgacctggggaccaacagcattggatgggcccttgtggagcaggatttcaagaataaacaaggcaacatcatggggatgggatccagagtcattcccatgtctcaggaaatcctgggcgagtttgctcgggggaatacaaagagcgaaacggccgagcgcaccagactccggtccgttcgcagactgcgggaacgccaccttctgagacgggagcgcctccatagagtgctgcacattctgggattcctccctaaacattacgtgaaccagatcgactttcaggagcggctgggcaagttctttgaagagtctgaaccgaagctggcgtatgatacaggcgacttcctgtttaaacccagcttcctcgagatgctggaggaatttaagatccaccaaccttccttcgtcgagggggataaaaaggtgccctacgactggaccatttattttcttcgcaaaaaggctctgacagaaagaatcgagaaggaggaactcgcctgggttattctgtctttcaatcagaaacggggatactatcagctgcgcggcgaggatgaagaggaaaagcctaacaaactcgaggaattttacagcctgaagatcgtggacattaaagtcgatgagtcccccaataagaaaggggacacctggtatagccttacactggagaacggatggatctacagacggtcttccaaggtgcctctcgatgactggctgggcaagaccagagatttcattgttacgaccgacatcgacgaagaggggaatccgaaacttgataaggaaggaaaccccaaacgcagcttccgggccccttctgaggacgattggggcctgagaaagaaaaagacagaaaaggagatcctcgactccagcaaaaccgtgggccattttattttcgagaatctgctggctgatcccacacagaagatcaaagggcgcctcgtccggaccattgaaagaaagttttacaaagacgagctgaagcaaatccttgtgtctcagaaccgcttccaccctgaactgtccgatgccgacatgatggctgattgcgtgcgggagctctataagcacaatcatagccaccagaactttctggcctccaaagacattaagcatcttctggtcgatgacatcatcttctaccagagacccctccgctctcaaaagagcacgattggaaattgtccgctggagtttaagacattcaaaaaggacggcatcgaaattaaggttccttataaagtggcgcccaagtcccaccctctgtttcaggagttccggctcctgcagtgggtgagctctcttagaatcattcgcaaatccgatgacagcgatgtcacccgggaatttctggggacacaagacaagaccaaacagctcctggattacctgatgacccagtctgagatggactgcaacaaacttatgacattcctcctgacgcaggaaggatataaaagaaaggatcttaagagcgaggtgggcaaatttcggtggaactacgttttcgactccgagaccggggaatctaagacatatcccggaaatagcacccgcgccgagttcctcaaaagactgggcaaggtggaaggctttgatttctccaaatacacagaggaatttgaggagagcctttggcacctggtctactctgtgaccgacaaggttgagttcgaaaaggctctccggaaattttccagaaagaacgggatcgaaatcaatagcttcgtggagaacctgaaaaagtttcccccttataaatctgaatacgcctcctatagcctgaaggctattaagaaacttctcgccctgatgcgcttcggagagaattggaaggaggattccatcgactctattagcaaacatcggatcgaaaagattctgacgggcgagtacgatccggaaatcaaagacaaggtcagagagatttcccgcgcgtttgacgaggtggaagatttccaagggctccccgtctggtttgccaactatgtggtttacggaagacactctgaggctagcgaactgatcaagtggacatccagcgacgagatggccgatttcatcaaagaatttaagcagcattctcttcggaatcctattgtggagcaggtcgtgctggagaccctccgcgttgtgaaagacatctgggataagtatggccacgggcagaaagacttcttcgatgaaattcatgtcgagctgggcagagaactgaagaaccccgctgagcaacgggcccgccttaccacacagatctccgccaatgaaaacaccaatctcagaattaaaagcctgctggtggagctcctgcacgaccctggagtggagaacgttcggccctactctccgatgcagcaggaaatccttaagatctacgaggaaggcgtcctgaagtccagctttgaggtgcctgatgacattctcaaaatctctaagacagctcaacccagctccagcgatctgaaacgctataagctgtggcttgaacagaaatacagatctccttatacggggaagattatccccctcaataagctgttcacccctgcgtacgaggtggagcacgtcattccccagtcccggtattttgacgatagcttctccaacaaagtgatctgtgaagccgctgttaataagctgaaagacaaccgcctcggaatggagtttatcaagtgcttccatggccagagagtgtctctggggtttggagaagaggtcgagattttcagcgaatccgcctacaaagcctttatccaagacaacttcccgaagaatcctgctaagaaacggaaacttctgatggatgagctccccgaacagatggtggagagacagatgaacgacacacgctatatttctaagtttgttaccagcatcctgtccaatattgtgcggtctgaagagaacgatacaggcttcaatagcaagaacatcatccccgggaatggcaaaattaccacggccctgaagcaagactggggacttaacgatgtctggaatgagctgatcctccctagattcgaacgcatgaaccagctgaccggcacaaccgtgtttacagcgtggaatgagaaccaccagaagttcctcccgaccgttcccctggaatacgctaaagggtttcagaagaaacggattgaccatagacaccacgccatggatgcccttgtgatcgcttgtgccacgcgcgaccatgtcaattacctgaacaatgagcacgctctcggaaagaactataaaggcaaggaagagaagcaatcccggagattcgatctgcgccagaaactgtgccttaagaaaaagaacgggcatagccaggagcagtacgaatggatcttttctaaaccttgggactccttcacacaagatgccaagaaaaatctggagcggatcattgtgagctttaagcagaacctcagagtgatcaataagacctctaacaaatatctgtcctacaaggacgaagagggaaatctccggctggacagccagggcaaacccgtcaaggcgcttacacgccagatcaaaggggatgcctgggctattagaaagtctatccacaaggacaccgtttccggcctggtgaaactccggcgcgtgaagatggtcaacctgagcgtggccctggataatcctgaaaacattcttaataaaaagctgaaaaagaagatcgctgagctcgttaaactgaactatgacaataagctcctgcttaaatacttcagagatcgggactatatgtttgatggaagagaggtgtccaagctggacgtctactacttcgaagagggcctggccgcgagccgcgtgtctctcgataccagcttttccgacaaaaagattcaatctatcacagatacggggatccggaagattctgcttgcccatctggctaactatcacggaagactcgacgaaaaaggcaaggttattccccctgagaccctggccttcacacccgaggggattgaggaactcaataaaaacatcaagggactgaatggcgggaaatttcaccagccgattttcaaggtgcgcacctacgaacctaaaggcaacaagttccaggtcggatttaagggcaacaaaaatagcaagtatgtggaggctgccaaagggacaaaccttttctttgccatctacctgaatgatgaaggaaagcggtcctatgagaccatccccttcaacgttgtgatggagagactgaaacaaggcgaagggcctgtcccccagacgaatgagaagggaggcaagctcctgtttcatctttctccgaacgaactggtgtacgtgcctgagacagacgaaaattataccaacgtcgacttcaaaaatctcagcaaggagcaggttgagaaaatttacaagatggtgtcctctaccggcagcgaatgtcactttgtgcgcgctgatatctccagcctgattaaagggtacgacgcgaagacaaaggtcggagagctcggctctctgaacaaacaggaagtgaccaataacgggatgacacggatcaaggagaaatgctggaagattaaaatcgatagacttggatccatttga

SEQ ID NO: 4604 - RNA, 4587 nt, synthetic construct
  misc_feature 1..4587: note = Cas9 variant
  source 1..4587: mol_type = other RNA
atgaagaaaatcctgggcattgacctcgggaccaacagcatcggatgggccgtggtcaattccttcgatgagaaccagaatgaagagtctctgaagcacattgaatgcgttggcagcagaatcattcccatggacgctgccatccttggggattttgacaaaggaaactccatctctcaaacagcgaagcggacggagttccgcagcgtgagacatctgcgggaacgccacctcctgagacgggctcgccttcataaaattctgtccctcctgggctttctgcctgatcactacgtgcaggacctcgattctcatgggaatttcccggtcaacgtggagcccaagatcgcctggagaaaggacagcaatggagcctttgagttcatttttaacgattccttcgacgaaatgctgcaggattttgctacctatcagcctgagcttatcgcctgtaataaaaaggttccctacgactggacaatttattacctgcggaaaaaggctctcaccaaaaagctgagcaaggaggagctttcttggatcctgctcaacttcaatcaaaaacgcggctattaccagctgagaggcgaggaagatgacgagtccgtcaagagcgccaaaacacggcagtattttgaccgccagaagattaaatctatcgtggataccaaccaaacatacaaggggcagaaagtgctgatcgttgaactcgaggacggaattaagggcaagatcttcaaaaaggaaattcctaattgggtggggcaggagaaatccatcattgtcaccatcgatatcgacaaggatggatgcgacaaatacgaggaaagcggcgagctgtcttgtagatttaagattccctccgatgcggaatgggagagcgaatggaaacttatcaaaatgaagacgcagaaagacctggatgcctccgggaagaccgtgggagcttatatttacgacgccatcctccaaaacccttctcagaaaattcggggcaagctggtgcgcacaatcgagagaaagtattacaaagaggaacttaagcagatcctgaaaaagcaagtcgagttccacccggaactccgggataaagacctgttcctggactgcctcaatgagctgtatcccaacaacgatgctcacagaaatgcctgtgcggaccgcgattttatttaccttttcatggacgatatcctgttttatcagcggcctctcaagagcaagaaatccctgattgccgactgcccctacgaaaagcatatgtacagagataaagagaccggcgagcttaagtatagctctgttaaatgtatcgctaagtcccaccctctgttccaggaatttcgcctctggcatttcattagcaacatccggatttaccagaaagagagagtggtggacgtcgatgccgaccaatctgctctgagctccgcccgctctgccctcaagagcaagctggaagctgatgtggacgttacaaatgagtttctgacctgcgaggcggattatgtgtcccttttcgaatggctgaacaataaaaagagcgtctctcagaaagactttctcaagtaccccgccttcgggatcaaaaagtccggagacaactatcggtggaattacgtggaggataagagctatccgtgtaacgaaacgagagctctgatcctgtctcaccttgagaaagccaatattcgcggcgacatctttacacgggaacaggaggaggccctctggcacattctgtactccgttgaagatagatacgagatcgtgaaggctctgcagagcttcgccgcgaaatatcgctttaacgacgatttcgtcaccgtgttctccaagtttcctcccttcaaaaaggaatacgggtcttatagcgctaaggccattaaaaagctcctgcctcttatgcggatgggaaaatactggtccgaggccgctatcgacatcaagacaagagaacggattgagaaaatcattaccggcgagtgcgatgactctatccgcgaaagagtccggctgaaggccattagactccatgatatcggggactttcgcgctctgcccgtgtggctggcctgttatgttgtgtacgatcggcacagcgagtccggagacatcaccaagtggaaaacaccccaagaaatggattggtatattcagaatttcaagcagcatagccttagaaaccctatcgtcgaacaggtgattacggaaaccctccgcgttgtgagagacatctggaaacaagtcggccggattgacgagatccacgtggagctgggccgcgaaatgaagaatccggcggataaaagagccaagatgacagctcggatgatcgagaacgaaaataccaacctgcgcattaaagccatgctcacagagtttctgaaccccgagttcgaaatcgagaatgtgagaccttactctgcttcccagcaggacattcttcggatctacgaaaacggggttctgaatagcgtctctgagattcccgaagagatcaccggcattctcaagaagtttaacgagcgcgaacagagaaaacggccttccacgagcgaggtgctgcgctataagctgtggcttgaacaaaaatacagatctccctatacaggaaagatgatcccgctcgggaaactgttcacccctgcctacgagatcgaacatattatcccccagagccggtattttgatgactccttcaataacaaggtgatttgcgaggcggaggtcaataagctgaaaggaaacctcctgggctacgaatttatcaagaaacaccacgggagacgcgtggatcttggcctgggagagattgttgacatcttcagcgtggatgaatatgagacctttgtcaaggactactactctgccaatcagcaaaagatgaagaagctcctgatggatgaaatccctgagcagttcattgagcggcagctgaacgactccagatatatcagcaaagtggttaagtcccttctctctaatattgtgcgcgaacaggatgagcaagaaagcatctccaaaaacctgattgtctgcacaggcggggtgaccgaccggctgaagaaagactggggaatcaatgatgtttggaacaagctcatcctgcccagattccagcgccttaataacattacagagacgaccgagtttacagctaagaacatgcagggccatgaaatccctgtggtccccttcgagtaccagcgggggtttaataaaaagagaattgaccaccgccatcacgccatggatgctatcgtgattgcctgtgccggacggaacatcgtgaattatctgaacaatgaatctgctcggaaaaaggcgcaaattagcagatacgacctccagcgcctgctgtgcgataaagtcaagaccgacgataacggcaattataagtggatccttaaaaagccgtggtccacactgacccaggacgtttacgccgctctcgataacgtgatcgtgtctttcaaacagaatctgagagtcattaacaagacgaataaccactatgtgcattacgaggccgggaaaaagatcattgccaaacaagaaaaggctagctgggccatccggaagcctatgcacaaagacaccgtttttggcgaggtgaatctccgcaaggtcaaaacagtgtccctgaacgaggcgattaagagcccccattgtatcgttcagaaagatttcaagaagaaacttctgtctctcctgaagcagaattttgacgctaaagaagtgaaggcctacttcgaggaacacaaagatgtctggtccgacatcaacctgagcaagattgaggtgtattactttaccaaggacacaaaagaaagattctttgccacccggaagccccttgattcttccttcgaccgcaaaaagatcgagagcgttacggatacaggcattcagaaaatcctgctcagacatctggagcaaaagaacggagactctgatctcgctttctcccctgacgggattgaagagatgaatcagaacatcgtgcagctgaatggaggccggaagcaccaaccgatcgtcaaagtgagagtgtatgaaaaggccgataaatttgcgattgggcagcagggaaacaaggctagcaaatacgtcgaggccgccaagggcaccaatcttttctttgctgtttatgaagaggaggtgcgcgacaaaaagacaaacgccgtgatgttcaagcggaattacgcttccatccccctgaacgtcgccattgatagacagaaaaaggggctcagcaccgcgcctgaagacgagaatggcaacgcccccatctttgtgctgtctcctaatgatctggtttatcttcccaccgctgaagacattatcaacgcccgcattagcttccctatcaataaaaaccggatctacaagatggtgtcctgcacaggataccaatgctttttcattaaacaccatgtcgctaatgtgatcgttgataagaaggagttttctgccctgaacaaaatggagaaggccgaaacgaatgagatgattaaagacatctgtgtgcccattaagctcgacagactgggcaacatcgtcaaaatcggggtgtataagtga

SEQ ID NO: 4605 - RNA, 4587 nt, synthetic construct
  misc_feature 1..4587: note = Cas9 variant
  source 1..4587: mol_type = other RNA
atgaagaaaatcctgggcctcgacctggggaccaacagcattggatgggccgtggtcaattccttcgatgagaaccagaatgaagagtctcttaagcacatcgaatgcgttggcagcagaattatccccatggacgctgccattctgggggattttgacaaaggaaactccatctctcaaacagcgaagcggacggagttccgcagcgtgagacatctccgggaacgccatctgcttagacgggctcgcctgcacaaaatcctctccctgctgggctttctccctgatcactacgtgcaggacctggattctcatgggaatttcccggtcaacgtggagcccaagattgcctggagaaaggacagcaatggagcctttgagttcatctttaacgattccttcgacgaaatgcttcaggattttgctacctatcagcctgagctgattgcctgtaataaaaaggttccctacgactggacaatctattacctccggaaaaaggctctgaccaaaaagctgagcaaggaggagctgtcttggattctcctgaacttcaatcaaaaacgcggctattaccagctgagaggcgaggaagatgacgagtccgtgaagtccgccaaaacacggcagtattttgaccgccagaagatcaaatctattgtcgataccaaccaaacatacaaggggcagaaagtgctcatcgttgaactggaggacggaatcaagggcaagattttcaaaaaggaaatccctaattgggtggggcaggagaaatccattatcgtcaccattgatatcgacaaggatggatgcgacaaatacgaggaaagcggcgagctttcttgtagatttaagatcccctccgatgcggaatgggagagcgaatggaagctgattaaaatgaagacgcagaaagacctcgatgcctccgggaagaccgtgggagcttatatctacgacgccattctgcaaaacccttctcagaaaatccggggcaaacttgtgcgcacaattgagagaaagtattacaaagaggaactgaagcagatcctcaaaaagcaagtcgagttccacccggaactgcgggataaagacctgttcctcgactgcctgaatgagctttatcccaacaacgatgctcacagaaatgcctgtgcggaccgcgattttatctacctgttcatggacgatattctcttttatcagcggcctcttaagagcaagaaatcccttatcgccgactgcccctacgaaaagcatatgtacagagataaagagaccggcgagctgaagtatagctctgttaaatgtattgctaagtcccaccctctcttccaggaatttcgcctgtggcatttcatcagcaacattcggatctaccagaaagagagagtggtggacgtcgatgcctgccaacccgacctgtctagcgctcgctccgccctcaagtctaagctggaagccgatgtggacgttacaaatgagtttcttacctgtgaggctgattatgtgagcctgttcgaatggctcaacaataaaaagtccgtcagccagaaagactttctgaagtacccggcgttcgggattaaaaagtctggagacaactatcggtggaattacgtggaggataagtcctatccttgcaacgaaacgagagccctgatccttagccacctcgagaaagctaatatccgcggcgacatttttacacgggaacaggaggaggccctgtggcacatcctgtactctgttgaagatagatacgagattgtgaaggccctccagtccttcgctgccaaatatcgctttaacgacgatttcgtcaccgtgttcagcaagtttccccctttcaaaaaggaatacgggtcctattctgcgaaggctatcaaaaagctgcttcccctgatgcggatgggaaaatactggagcgaggccgccattgacatcaagacaagagaacggatcgagaaaattatcaccggcgagtgtgatgactccattcgcgaaagagtccggctcaaggctatcagactgcatgatattggggactttcgcgccctgcccgtgtggcttgcttgctatgttgtgtacgatcggcactctgagagcggagacatcaccaagtggaaaacacctcaagaaatggattggtatatccagaatttcaagcagcattccctcagaaacccgattgtcgaacaggtgatcacggaaaccctgcgcgttgtgagagacatttggaaacaagtcggccggatcgacgagattcacgtggagctgggccgcgaaatgaagaatcccgccgataaaagagcgaagatgacagcccggatgatcgagaacgaaaataccaacctccgcatcaaagctatgctgacagagtttcttaaccctgagttcaagattgaaaatgtgagaccctacagcgcctctcagcaggacatcctgcggatttacgagaacggggttctcaattccgtcagcgaaatccctgaggaaattaccggaatcctgaagaaatttaacgagcgcgagcagagaaagcggccctctacgtccgaagtgctgcgctataaactttggctcgagcaaaagtacagaagcccgtatacaggcaaaatgattcctctggggaagctgttcacccccgcttacgaaatcgagcatatcattcctcagtctcggtattttgatgacagcttcaataacaaggtgatctgcgaagccgaggtcaataaactcaagggaaacctgcttggctacgagtttattaaaaagcaccacgggagacgcgtggatctgggcctcggagaaatcgttgacattttctccgtggatgagtatgaaacctttgtcaaagactactacagcgcgaatcagcaaaagatgaagaaactgctgatggatgagatccccgaacagttcatcgagcggcagcttaacgactctagatatatttccaaggtggttaaaagcctcctgtccaatatcgtgcgcgagcaggatgaacaagagtctattagcaagaacctgatcgtctgtacaggcggggtgaccgaccggctcaaaaaggactggggaattaatgatgtttggaacaagctgatccttcctagattccagcgcctgaataacatcacagaaacgaccgagtttacagccaaaaacatgcagggccatgagattcccgtggtcccgttcgaataccagcgggggtttaataagaaaagaatcgaccaccgccatcacgctatggatgccattgtgatcgcttgcgccggacggaacattgtgaattatctcaacaatgagtccgccagaaagaaagctcaaatctctcggtacgacctgcagcgcctgctttgtgataaggtcaagaccgacgataacggcaattataaatggattctgaagaaaccttggagcacactcacccaggacgtttacgcggccctggataacgtgatcgtgtccttcaagcagaatctcagagtcatcaacaaaacgaataaccactatgtgcattacgaagctgggaagaaaattatcgccaagcaagagaaggcctcttgggctattcggaaacccatgcacaaggacaccgtttttggcgaagtgaatctgcgcaaagtcaagacagtgagccttaacgaggccatcaaaagcccccattgcattgttcagaaggatttcaagaaaaagctgctcagcctgctgaaacagaattttgacgcgaaggaggtgaaggcttacttcgaggaacacaaggatgtctggtctgacatcaacctttccaagatcgaagtgtattactttaccaaagacacaaaggagagattctttgccacccggaaacctctggatagctctttcgacagaaagaaaattgaatccgttacggatacaggaatccaaaagattctcctgcgccatctcgagcagaagaacggcgacagcgatctggccttctctccggacgggatcgaggaaatgaatcagaacattgtgcagcttaatggaggccggaaacaccaacccatcgtcaaggtgagagtgtatgagaaagctgataagtttgccatcgggcagcagggaaacaaagcgtccaagtacgtcgaagctgccaaaggcaccaatctgttctttgccgtttatgaggaagaggtgcgcgacaagaagacaaacgctgtgatgttcaaacggaattacgccagcattcctctcaacgtcgctatcgatagacagaagaaagggctgtccaccgcccccgaggacgaaaatggcaacgcgcctatttttgtgctgagccccaatgatcttgtttatctgcctaccgccgaggacatcattaacgctcgcatctctttccccattaataagaaccggatctacaaaatggtgagctgtacaggataccaatgctttttcatcaagcaccatgtcgccaatgtgattgttgataagaaagaattttccgctctcaacaagatggagaaagccgagacgaatgaaatgatcaaggacatttgtgtgccgatcaaactggacagactcggcaacattgtcaagatcggggtgtataagtga

SEQ ID NO: 4606 - RNA, 4590 nt, synthetic construct
  misc_feature 1..4590: note = Cas9 variant
  source 1..4590: mol_type = other RNA
atgaagaaaatcctgggcctcgacctggggaccaacagcattggatgggccgtggtcaattccttcgatgagaaccagaatgaagagtctcttaagcacatcgaatgcctgggcagcagaattatccccatggacgctgccattctcggggattttgacaaaggaaactccatctctcaaacagcgaagcggacggagttccgcggcgttagacatctgcgggaacgccaccttctgagacgggctcgcctccataaaatcctgagactgctcgggtttctgcctgatcactacgtgcaggaccttgatggacatggcaatttcctggtgaacgtcgagccgaagattgcctggcggaaggacagcaatggcacctttgagttcatctttaacgattccttcgacgaaatgctccaggattttgccacatatcagcccgagctgattgcttgtaatcgcaaagtgccttacgactggaccatctattaccttagaaagaaagccctgacaaagaaactctctaaggaggaactgagctggattctgctcaacttcaatcaaaagcgggggtattaccagctgcgcggagaggaagatgacgagtccgttaaaaccgctaagacaagacagtattttgaccggcagaaaatcaagagcattgtggataccaaccaaacgtacaaaggccagaaggtccttatcgtggaactggaggacggggttaaaggaaagatcttcaagaaagaaattcccaattgggtgggccaggagaagtctatcattgtcaccgtggatatcgacaaagatgggtgcgacaagtacgaggaatccggagagctcagctgtcgctttaaaattccttctgatgccgaatgggagtccgaatggaagctgatcaagatgaaaacacagaaggaccttgatgcgagcggcaaaaccgtgggcgcctatatctacgacgctattctgcaaaacccctctcagaagatcagagggaaactcgtccggacaattgagagaaagtattacaaggaggaactgaaacagatcctgaagaaacaagttgagttccaccctgaactccgcgataaggacctgttccttgactgcctgaatgagctctatccgaacaacgatgcccaccggaatgcttgtgccgacagagattttatttacctgttcatggacgatatccttttctatcagcgccccctgaaatccaaaaagagcctcatcgcggactgcccttacgaaaaacatatgtaccgggataaggagaccggagagctgaaatattcctctgtgaagtgtattgccaaaagccaccccctgttccaggaatttagactctggcatttcatctccaacattcgcatctaccagaaggagcgggtgattgacgtcgatgcttgccaacctgacctgagctctgccagatccgctcttaaaagcaagctggaagccgatgtggacgttacgaatgagtttctcacatgtgaggccgattatgtgtctctgttcgaatggctgaacaataagaaaagcgtctcccagaaggactttcttaaataccccgctttcggcatcaagaaatctggggacaactatcgctggaattacgtggaggataagagctatccgtgcaacgaaacccgggcgctcattctgtcccacctggagaaggccaatatcagaggagacatctttacacgcgaacaggaggaggctctctggcacattctgtacagcgttgaagatcggtacgagatcgtgaaagcccttcagtctttcgccgctaagtatagatttaacgacgatttcgtcaccgtgttctccaaatttcctcccttcaagaaagaatacggcagctattctgccaaggcgattaagaaactgctccctctgatgcggatggggaagtactggtccgagagcgctatcgacattaaaacccgcgaaagaatcgagaagatcattacaggagagtgtgatgactccatccgggaaagagtccgcctgaaagccattcggcttcatgatatcgagcactttagagccctccccgtgtggctggcttgctatgttgtgtacgaccgccattctgaaagcggcgatattatgaagtggaagacgccccaagagatggactcctatatccagaatttcaaacagcactctctgagaaaccctatcgtcgaacaggtgattaccgagacactccgggttgtgcgcgatatctggaagcaagtcggcagaattgacgagatccatgtggaactggggcgggagatgaaaaatccggccgacaagcgcaaagaaatgaccaagagaattatcgagaacgagaatacaaaccttcggatcaaagctatgctgaccgaatttctcaaccccgagttcgaaattgagaatgtgcgcccttacagcgcctcccagcaggatatcctgagaatttacgaaaacggagttctgaatagcgtctctgagatccccgaggaaattacgggcatccttaagaagtttaacgagcgggaacagcgcaaaagaccttccacaagcgaggtgctccggtataagctgtggctggaacaaaaatactgctctccctataccgggaagatgattccgctcggaaaactgttcacccctgcgtacgagatcgagcacgtgatcccccagtccagatattttgacgatagcttcaataacaaggtcatttgtgaagccgaggtgaataaacttaaaggcaacctgctcgggtacgaatttatcaagaaacaccatggccagcgcgttgacctgggactgggcgagattgtggatatcttctctgtcgacgaatatgagacatttgtgaaggattactacagcgggaatcaacagaaaatgaagaaacttctcatggacgagattcctgaacagttcatcgagcggcagctgaacgattccagatatatcagcaaggttgtgaagtctctgctctccaatattgtccgcgaacaagacgagcaggagagcatctccaaaaacgtgattgtttgcaccggaggcgtgacagatcggctgaagaaagactgggggatcaatgacgtctggaacaaacttattctgcccagattccagcgcctcaataacatcacggaaaccacagagtttaccgctaagaacatggaaggacacgagatccctgtggtgcccttcgaataccagcggggctttaataagaagagaattgatcatcgccaccacgccatggacgctatcgtcattgcctgtgcgtctcggaacatcgttaattatctgaacaatgagagcgccagaaagaaggctcggatttcccgctacgatctgcaaaaacttctgtgcgacaaggtgagaacagatgacaacgggaattataagtggatcctcaaaaagccgtggggcaccctgacgcaggatgtgtacgccgctctcgacaacgtcattgtgtctttcaaacagaatctgcgggttatcaacaagaccaaaaattattacgtgcattacgaggccggaaagaaaacaatcgccaagcaggaaaagggcagctcctgggctattcgcaaacctatgcacaaggataccgtctttggggaggtgaaccttagaaaagttaagacagtgtctctgaatgaagcgatcaaaaacccccaatgtattgtcgagaaggacttcaagaaaaagctcctgagcctgcttaaacagaattttgatgccaagaaagtgaaggcttatttcgaggaacataaggacgtttggtccgatatcaacctgagcaaaattgaggtgtactattttaccaaggacacgaaagaacggttctttgccacaagaaagcccctcgactcttccttcgataaaaaggagatcgaaagcgtcaccgacacaggaatccagaagattctgctccgccacctggagcaaaagaacggcgatcctgaccttgccttctctccggatgggatcgaagagatgaatcataacattgtgcagctgaatggaggccggaagcaccagcccatcgtgaaagtcagagtttacgagaaggctgacaaatttgccattgggcagcaaggcaacaagtccagcaaatatgtggaagcggctaagggaaccaatctcttctttgccgtgtacgaggaagaggtccgcgataagaaaaccaacgccgtgatgctgaagcggcactatgcttctatccctctgaatgttgccatcgacagacagaaaaagggcctttccacagcgcccgaggatgaaaacgggaatgtgcctattttcgtcctgagccccaacgacctcgtgtacctgcctacggctgaggatatcgccaatgcctccattagctttcccatcaacaaaaatcgcatttacaagatggtttcttgcaccggaaaccggtgtttctttatcaagcatcacgtggctaatgtcattgtggacaaaagcgaattttccgtcctcaacaagatcgagaaagccgaaacagatgagatgatcaaggagatttgcgtgccgatcaaaattgacagactgggcaatatcgttaagattggggtgtataagtga

SEQ ID NO: 4607 - RNA, 4608 nt, synthetic construct
  misc_feature 1..4608: note = Cas9 variant
  source 1..4608: mol_type = other RNA
atgaacaccatcctgggcctcgacctggggacaaatagcattggatgggcccttatcaaggtgctgaacgataaaacgagactccccctggagattatcgaccttggcgtcgttgtgattcctaccgatcagcggacactggacaagttctccaaaggggaatctatcagcaagaccgctgagcgcacaaaacaaaagggagtgagaaagctctacgaacggaaaaagctgcgcagagagcggctgcaccgcgtcctcaatatcctgggctttcttccggaacattattccaaaaagattgatttcaaaaagcacctggggcagtttttcggaaactctcagcccaagatcagctacgtggagaatgaccatggcaaacacgagtttattttcatggattcctatagagaaatgctcaaggagttttctaaacataacatcaagaatgttccttacgactggaccatttattacctgcggaaaaaggcccttagccagaaaatctccaaggaggaactggcgtgggtgattctcaacttcaataagaaacgcggctattaccaatttagagatgacaacgctgatgagaataaggaaaacaaaatcgagaagtactatgccctgaaagtcacaaatgtgaagaaggaagacgcccagaactacaccatcacgctggagaatgggtggatttataaaaacaagagcaaaatctctctcctggattgggttggatccaccaaggagttcattagcacagaaaaatttgacaacaagggcaatatcattaagaaaaagaacggggaggacgatcggacccttaaactggtggactctgaaaaggattggatcgctatcaaaaagtccacagaggaccgcattgaaaattacggaaagaccgtcggcacgtatctctacgagcatctgcttaaagatcccaaccagaagctgaatggggaactcatcaacattatcgacagaaaattctataagaatgagctgaaacagattctggagaagcaaaaagaatttcaccctgagctcctgaacgaagatcttttccaaaagagcatcatcgagctgtaccccaaaaattctacacggcagaaagaactcaagaacaaagacctgtgctaccttctgattgatgacgtgatctattaccagcgcgatctcaagaaaaagaactccaccattaataagtgtagcttcgagtccagagagtattacctgaatggagaaaaacagatccagaagattaactgcatcgccaaatctaagcctctgtatcaggagtttcggacactccaattcattaaaaatctgaaggtgtacgaaatcatcgacggccttgagaaggacattaccagcaaactgctcccggattttgagaccaaggaacacttctttgagtggctgaacgacaaagaaaagatcgatcagctgcagcttctctcctataaatgtttcgacctgcacgataacgtcaagaatgacctgattgctaagggcatcaaaagacccacagagaaggccattcgcacggaactcctggagaaataccggtggaactacagcaaggataatgacagaaactttcttctgaatgagacccgcttcaaaatcctcaagtatctgaaaaaggttgataagaaactgacacttaccaacgaacagatcgagtctctctggctgctgctctactccgcgaaggacgaacgggagctgaaaaatgggcttcaaaagtttagcgaaaagaacaagctgcctaagaaattctctgatatttttatcagctttccccctttcaagaaagagtatggagcctactccgagaaggctctcaaaaagctgctgtctcttgtgagattcggcaagtattggagcttcaataaaattgacaacaatatccagaacaagattatgaatatcctcaacggggaagtggatgactccatcagcgaccgcgtccgggagaaaacaattctgctgcaggataagaatgactttcaggatctccccctgtggcttgcctcttacgtggcttataacagattctccgaagttagcgagatcaaatactgggactctccggataagattgaatttctgaagcaacattccatcggaaaccctattgtggagaaaatcatcaatgagaccctcaagctgattaaagacatctgggtcattcacggcaagagctgcaaaaacttcttttccgaaatccacattgagctgtctcgcgaaatcaagagctcctctaagaaacgggcccagattacgaataacaatacaaagaaccagaaacttaataacctcatcaagagcctgctgatcgagatggcgtccgataccaaatacgagaatgtgaccccctatagcccttctcagcaagaaattctcaagatctacgacgaggggatttattccaaagaagagaacagcgaaaagatcaaggagattaataaaatcagaaacaataacaagatctctaaatccgatattacaaagtacaaactgtggcttgagcagggatatatcagcccctacaccggcaagattatccccctgacaaaactcttcacggccaagtatcagaaggaacatattatccctcagaccaaatttttcgacgattcttttaataacaaggttatctgtgaggctgaagtgaacaaactgaaggacaatagcctggccatgaacttcattaaggctaaaggcgggaaggccgtcaaactttccgatggagagacagtgaccatcctgaatcaagaagagtacaagcagctcgtccgcaccagctttaaaaagaactctattaagctgcggaatctcctgcttgaggaaatcccggacaccttcacgaaaagacagctgaacgacaccaagtacatttccaaactcgtgctgagcctgctttccaatatcgttcgggagaagggcgaactggagtctacagccaaacgcattgtgagcaccaacgggcaaatcacatccatcctcagaaatgattggggactgaacaatatttggaacaagctcatcacaccccggtttgaaagactgaataacattaataaaaacaagatctatggcaattgggagaacaagaaagggaagaacgtcttccagattaattaccttaacgacaatctgtctacgctcaacacaaaacgcatcgatcaccggcatcacgctctggacgcgctgatcgtggcctgcaccacaagaaatcatattaacttccttaataaccagtatgctaagagccgcaatcagagacacgatctgcgggccaaactcaagcgcagagagaccatcaccacagaaggctccaagaaacaagtttttaaggacttcattaaaccttgggagtcttttacgcaggatgccctgaagaaactcgaaaccacaatcgtgaacttcaaggtcaataagcggattatcaacaaaaccatcaattggtacaagaaatgggagaagcagaaagacggaacatataagaagattcagaaaaagcaaaccaaaggcgatgcttgggccatccgcaagcccctgcacattgacacgatctacgggattgtgtgtaaaaagctgcctcttaaaagcgcgctggagaactataagaatatcattgatgaaaacctcaagcataaaatcaaggagctgaaagaagtgaacaagtttgacaataaccagatcattaatttctttaaagagtgcaacttcatctttgaagacaataacattcagaaggttgaggtctacgatttcaaggacaatagagataaaacaatcctttccagctctcggcagctgattgacgagtcctttacccccaagaaaatcggaaaggtgctcgatccgaccatccgcaacattctgctcaaacacctgaatagcacaaagtacaacaataagttcgactctgatggcaaccctatcaaacccgaaaaacttgctttctcccctgaggggctgaaggacctgaataagaacattaaacatctcaataacaacaaggaacaccaacccatcaagagagtgaaactgtttgagacccttggaaataagattaaagtcggctatacacagcagaagaacaaaaagttcgccgaaacggccaccgggacaaatctgtttctcggcatctacagcgataacaataagcgggacttcaaaaccatccctctgattctcgctatccaacgcgagaaggagggactgaacccctgtccggatacagacgaaaaaggcaatcagcttctgttttctctgtcccctaacgagctcgtgttcgttcccaataacgaagagagaaagaatcccaacctggtggattttgaaaatcttagcaaagaccagattgaccggatctataagttcgtctcctgcaccgggagcgaggcctactttgtgccttctagaacggctaaaccgattatcgagaacgaaaatggaaccaacaacaagagccagcgcattatcgagttcaatgaaaagacatccatcaaaaacgagaagaatgagcccgttctgattaaaaccatctgttggaagattgaagtgaaccggctcggcaaaatcattaaggtcatcaagtga

SEQ ID NO: 4608 - RNA, 4608 nt, synthetic construct
  misc_feature 1..4608: note = Cas9 variant
  source 1..4608: mol_type = other RNA
atgaccaagatcctgggcctcgacctggggacaaacagcattggatgggccatcagagatacggagaatgaaggcattaaccagatccttgacaaaggggctcggattttctccgagggagtgaagtctgaaaatggcaaagagatcagccgcgccgcggaaagaaccgcttaccggtccgcccgcaagatcaaatatagacggaagctgcgcaagtacgagacactcaaagtcctgtctattaacgggatgtgcccccttagcgttgaggaagtggagcaatggaagaaatccggatttaaggaatatcctctgaatccggagttcctcgattggctgagaaccaacgaggacaaaaatatcaacccctacctgtttcgggataaggcctctaagcagaaagtgacactcttcgaactgggccgcgctctttatcacattgcccagagacggggctttctgagcaatcgcctcgaccagtccgctgagggggtcttcgaggaacataaccctcaaatccagaatctgattgaagatcttgacagctctaacaccatcctgaatgagctcaaggagtactatattaacctgggaatcatcgatgaaacagagaaatccggctttaagaaagacctggatgaaggggagaagaaactcaagagcctgtacaattctcttgtggccattaccaagaaaaacgcgaacgacatcgaaacgtgtaagcaggagctgattgccagactcaataaaaaggaggatctgggaaaagttaagggcaagatcaaagacatttcccaggctatgcttgaccggaacttcaagaccctggggcaatactttttcagcctctataataaagaacgcatcagaaaccagtacacatctcgggaggaacactatctggaggaatttatcattatctgccagacccagggaattgagggcatcaatacaaacgagaagctgcccgaaaagaagttcaccggcctcgccaaggatctgtacagagctatctttttccaacgccctcttaaatcccagaaggggctgattggaaaatgtagcttcgagaagaataaatcccggtgcgccgtgtctcatcccgactatgaagagtttagaatgtggagctacctcaacacgatcaagattggcacacagtccgagaagaccctgcgcttccttacactggaagagaaactcaagctggtccctaaattttatagaaagagcgatttcaattttgaagtgctggcgaaagagctcgttgaaaagggggcctctttcggatactacaaatccagcaagaagaacgagtttttctattggtttaattacaaaccgaccgactctgtgagcgcttgtgtcgtgtccgcctctctggagaacgctatcggcaaggattggaaaattaagaccttcgaatatcaaacacggaatacggagaaaaacgaagtgaccaagagcgtcgactacaaggatctttggcatctgctctccgttgccacaagcgacacctatctgtacgattttgccatcgagaaactgaaacttgaacccaaaaatgctaaggcgttctctaaaacaaagctcaagaaagactttgcctccctgagcctggctgccattgccaagatcctcccttatctgaaacaggggcttctgtactctcacgctgtgttcatggccaacattgagaacatcgtggatgcggacatctggaaggacgaggaacagcagaaattcattcaatccaagatcgtcgagctcgtggataattacattgttgaaaagagcaaactggagctgatcaacggacttctcaagatttataataccgaagacaaagagggccgcaaggtgtactattccaaagaggctgaatctctgtttgaggccgatctgcggaagaaactcgtccccttctacaaggccaacatcatcattgaggaacacgagcaggaaatcatttttcaggacctgttccctatccttatggatcagctgaagaaacaagagtttattaagatcggcagactcgacaaacagatcgaagcgttcctggagggggaaaatgaggagggacagatcttttgcaaccacacggataagctgaaaaagctctatcatcccagcgacattgaagtgttcaagaaaaagacaattaaagatgagtggggcaatgaaaaggttgtgcttgggtccccgctgaccacctctatcaaaaaccctatggccatgcgcgctctgcaccagctccggaaggtcctgaatacacttattgccaacgaccaaatcgatgaggacaccagaatccatattgaaatggcgcgcgagctgaatgatgccaacaagcggaaaggaatccaggactttcagaatgagaacaagaaattcagagaagaggctattaaggaaatcaaaaagctctacctggaggaatgtcacaaggacgtgaatcccacagaggatgacattctgcggtatcagctttggctcgagcaaggcaaatgcgaaatctacgaggaagggaacaacattagcatctgtgatatcattggctccaatcctagctacgacatcgagcacacgattccccgctctatctcccaggataacagccagatgaataagaccctgtgctctctgaaatttaacagatccattaagaaacaaaagatgcccgtcgagctcagcaattataacgacatcctgcctcggatcgcccattggaagaaagaagctgaggaacttacaagacagattgagaccatctctcgcagcattaagtccgccgcgacaaaagtggccaaggataaaaatatccggaagagacactacctgaccctcaaacgcgactatattctgggaaagtacgaaagattcacgtgggaggagccgaaggttggctttaaaaacagccagatccccgataccgggatcattacaaagtatgctcaggcctacctgaaatcttatttcaagcgggtggaatccgtcaaaggaggcgctgtggccgagttccgcaaactttgggggatccaagagagctttattgacgaaaattggtggaagcattacaaagataaggacagagataaacacacccatcacacaatcgacgccattaccatcgcttgtatgcctaaggacaaatacgatctgctcgcgcacgcctggcggctggaagacgagcaggataagaaggctgccaaagttctcattgagcaggccaagccctggaaaacgttcaaggaagacatcgagaaaatcgaaacagagattctggtgtcccattttacccctgataacgtcaagaagcagtctaaaagcatcattaagaatcgcggaaagaaggtgtatgtgcttaaaaacgaactgcccgttaatttcaagaacaaaatcgagggcaaggactactttaagctcaaattcgattccaagattctgtataaaatcccgaagaaaaaggagaagcaaacagacaccttttacgaggaactgcctaaaaattatcttaacggggtcgaaggcaaggattacttcaaaatcaacaccacaggaaagacgttttataaaattcccatcttcaatcagggcgacaccattagagggtctctgcaccaggagacaacctacggagctatcaagctccctgatattgacatcgagacaaagaaacccctgcataccgacaagggcgggtttatcctcaaaaaggatattaaaggaaacgaaatcgtgttcttcgtggtccggaaggagattagcaagatctccgaaaatgacgtgcagaacattgttgataatgtggtccgcaaaaagatcgagaacgccattgctaattctctgatcacgtttaaaatcgtgaagaaaaagaaagttgctgtgattaaggaaggcgtcacaatctggatgagagagcctaacattgagaaggggatcgaaggcattcccatcaaaaaggtgcggatcattaccaatagcgttaaaaacccgatcgagattaaggtgcactcccctcttagcaaatctcgccacaagcataagcaaaaagtctacggacagaatgacgaaaactatgccatggccctgtacgagctcgatggcaagagagagttcgaactgatcaataactttaatctggctaaacttctgaagcagtcccaaagctattaccccctccacaaagagaaggaaattaaggggaaaaagatcctggtgcccatcgagaaacggaacaataaggacgtgattctcaaaagaggacagcaggtcgttttctatgataagaccgtggaaaaccctaaggacatctctgagattatcgattttcgcgaacggatttacatcattgagggcctgacaatccagagacaaaaagacaagaaaacctccaaggtgaacgagtatgggatcattcagcttcgccatttcaaagaagccagaaagagcgaggaaatctctaaggataattttaaaccggacggagagttcaagattaacgagaataaacccacacggaagatgaaccacaatcagtttacggcgttcgtcgaaggcatcgattttaaagtgctgccttccgggaagttccagaaaatttga

SEQ ID NO: 4609 - RNA, 4614 nt, synthetic construct
  misc_feature 1..4614: note = Cas9 variant
  source 1..4614: mol_type = other RNA
atgaagaaaatcctgggcctcgacctggggaccaacagcattggatgggcccttacaacgaatgatttcgacaccaagaaaggcacaatcgaggggctgggatccagaattatccccatgtctcaggatattctcggcaagtttgacagcggggtgtccctgtctcaaaccgctcagcggacagaataccgcggaaaaagacggcttgtccagcgcttcctgctcagacgggagcgcctgcacagagttctgcatatcctcgaactgcttcctaagcagtatagcgaggccatcgattttgacaagaaactgggccaattcaagccggaacgggagcagaaaatttccttttacaagaacgagtctggcaaaaatcagttcatctttaccaagagccaccaggaaatgctcacagagttccaaacctattaccccacgattaagaacatcccttatgattggaccatttactatctgcgcaaaaaggcgcttacagaaaagatctccaaggaggagctggcttggattctcctgaattttaaccagaaaagagggtactaccagctgcggggagaagagaaggaagagaataaaaacaagaaggaagagttccataccctcctggtgacagacatcatcgagcgcgataaaggcaagagcgggacctggtataatgtgattcttgaaaacggatggatctacaaaagagagtctaagatttccctggccgactggatcggcaaaacaaagagctttattgtcacgaccgaatataatgatgacgggtctgtgaagctcacaaaagataacgaggaaaagcggtccttccgcagccccaaagaggacgactggggactgatcaagatcagaaccgagaaaaccattaatcagtctgataagtccgttggcgcctacatctatgacgcccttctgaagaaccctaatcaaaagattaagggcgaactcgtgcggacaatcgagagaaaatactataaggatgaactgcgcgagattctgaaaaagcagctcgaatttcacagcgacgtcctgaacgataagatcctttacaaaaagtgcatcgacgagctgtacaaaaacaatgattcccataagaactctattaaagaccgggggttcgattatctcttcctggacgatatcattttctaccagagaccccttaagagcaaaacgtccctgatcagcgactgttctctcgagttccgccctattaagaataagaacggagtgctggttaaagacaccgatggcaagcaaatcgctaaagctctgaagtgcattgcccggtccaatccgatctttcaggaatttagactcctgcagtttgtgaaaaaccttaagatctataagcgcggggtcgtggacgatgtggaggtcacaaatgactacctgaaaagcgaaaacgatgttgagaaactcttcaattggctgaacgacaaagcggagattaatcagaagcaatttctggtgaacttcaaacttaaggaagataagcaccggtggaattttgtggaggacaaaggatatccctgtaacgaaaccagaaatcagttcctcaacgccatcgctaagattgatgtcgacaaatctttcttcaacacaaagaatacccaggatctgtggcacatcctgtacagcgtgacggacaaaattgagatcacaaaggccatcaccacctttgctaagcgccataacctccctaatgaatttattatcaacttctccaaaattaagccctataaaaaggagtacggctcttttagcgagaaagccatcaagaaactgcttcctctgatgcggttcgggtcctactgggatgcgaagaatattgacatcaagacactcgacagaatcgataaaattcagaccggagaatttgacgagaagatccgcaaccgggttagagaaaaagccattgatctgcacaagatcgacgatttcaaagacctgcccctttggctcgctagctatattgtgtacgataagcattctgaggcctccgacgtcagcaagtggaaaacaccggctgatatcgaaaagtttctgaaacacgagttcaagcaacactctctgcggaatcctatcgtggagcaggttattacggaaaccctccgcgtggtcaaagacatctggctgcagtatggcgagggcaaggaaaactttttcaatgagattcatatcgaacttgggagagagatgaagaacgataaagccacacgggagaagatttccaaaaaggtgagcgaaaatgagaacaccaatctgagaatcaaagccattctcacagaactgaagaacgacggagtctccgatatccgcccctactctcctagccagcaagagatcctgaagatttatgaggaaggcgtgtacaataacgagtcccggaaagaaaaacttgaggaagttgacaaaatcagaaagaacgctaaacccaccacgtctgagattatcaagtataagctctggctggagcaggggtacgcgagcccctacaccggaaaactgattcctatgtccgaactctttacaaccaagtatcagatcgagcacatcattccgcagagccgcttctttgacgattctctgtccaataaagtgatctgcgaaagcgaggtcaacgaacttaagtctaatatgacagccctggagttcattctcaccaacgagaatagaatcgtgacgctgacaggcggggaaaccgttaaaatttttacaaaggaggcttacaaccaacatatcatctcctattacagcaaaaataagaacaagcagaaacggctgcttaccgaagagattcccgaacagttcatctctcgccaactcaatgacaccaagtatattagcaaaatcgtgaagaacctgctgtccaaaattgtcagagaggaggatgaacaggaggtgacaagcaagcacgtggtttctctcaatggctccatcacgagccggatgaagcaggactggggactgaacgatgtctggaataccattgtgtcccctcgcttcgaaagacttaacacactgaccaattctaacgactttggccagttcgagctcaaaaaggatgcctacgggaacgagggaaaacgggtgtttcaaacaaccgtccccgacgccatcgctaagggcttcacgaaaaagcgcatcgatcatagacaccacgccctggacgcgctggtgattgcttgtgttaatcggacacatatcaactatcttaataacctgaatgccaaggataccgacgacaaagccgtgaagcacgaactccgcaacaaactgtgctttaagaccaaacctgatagcaatgggaactacaagtgggagttccataagccctgggaaaaatttacaaaggaggctcaggacaaactcaataccacaattgtctccttcaagcagaacacgagagtgatcaataaaaccgttaacaagtacgtgtcttataaagatgaaaatggaaacctgaatgtcgacgccaacggccttccgcagaagaaggtgattacacaaaccaaaggggataattgggctatccggaagcctctgcacgccgagacagttagcggcaaagtgtttctcaagagaatcaaacagtcccacattaccatcgcgaacgccattgagcaggtcgaactgatcgtggacaaggaggtgaagaaacagctgaaggctaaaattaaactttaccccaacaatatcgccggactgaagaagcatctcaaggctttccctgtcatgatcaacgataaagccattgacaagatccaaatttatgaaacgctggaggcgaccgccacacgcaaaatcctcgatattacctttgacgaaaagaaaatccagaagattacagataccggcatccagaagatcctgcttaatcacctgaaacaagagaagtaccagaacacagttgacgagaatgggaaaaagctcgctccccatgaaattgccttctctgagaacggactggaagatctgaataaaaacatcaccttccttaatgacggcaagaaccaccagcctattaaaaaggtgcggatctttgaggaagggaataagttccccctgggagaggtgggcaacaaaattaataagtttgtcgagacggctaaagggacaaacctcttctttgccgtgtatgaaaatgacgataagaaaagaaactacaagaccatcccgttcaacgaggttatcgaacgccagaagcaaggcctgaatgccgctctcgagattgacgagaacggaaatcggctgctttttaccctgagccctaacgatctggtgtatatccccctcgaagacgagattggctacctgaatggggtctacttcaaaaaccttaataaggaacagacagtgagaatctataaatttgtttcctgtaccggaggcgaggggcatttcgtgcccaacaattacagcaaggaaattatctctaacgagaatggatccaacaataaaaacgagcgcatgctgaattttaacaacttcaatatcatttttgatggcaaggaaaagcctgtcatgatcaaaagcatttgctggaagctcgaggtggaccggctggggaaagttatcaagattatcaaatga

SEQ ID NO: 4610 - RNA, 4617 nt, synthetic construct
  misc_feature 1..4617: note = Cas9 variant
  source 1..4617: mol_type = other RNA
atgaagcacatcctgggcctcgacctggggaccaacagcattggatgggcccttgtgaaatccgagcaggattgcgacgatgtcgaaagaatcaatggcattgaggctgccgggtctcggatcattcccatggacgcggctgttctgggagatttcgccaagggcaacacaaaaagccaaacggccgaccgcaccgctgccagagggatccggcgcatgggagaaagacataagctccggcgcgagagactgaatcgggtgcttgatgtgatgggctttctgcctgaacactactccgctgccctcacacgctatggcaaattcaaggacggggaggagtgtaagatcgcgtggagaaaagatgaatctggacagtggacctttgtcttcgaggacagctttcgggaaatgctggccgatttcgtggctcatcagccggagtggctggccggcgggcgcaaggttccctacgactggacaatttattacctccggaaaaaggctctgtccaaacctcttaccaagcaggagctggcctggctcctgcttaactttaatcaaaagcggggatattaccagctgcgcggcgaagatgagcacacagacgacaaagggaagctcgtggaatattacgcgctgaaagtcgtgggagttgaggataccggcgacaagaaaggcaaggatacgtggttcaacatcatgctggaaaatgggatggtgtacagacggcccgccgctgaggcccctgactggattggaaaaaccaaggagtttatcgtcacaaccgatctcgaaaaggacggcacacccaaaaaggataaagaggggaacattaagagatctttccgcatgcctaaagaagacgattggaccctgatcaagaagaaaacggagaatgacattgatcggagcggaaagacagtgggcgaatatatctacgacgcgcttctggccgacccgacccagaaaatcagagggaagctcgtgcgcacagtcgagcggaaatattacaaggaggaactgaagaaaattatcaactcccagaagagatttattcccgagcttaatgataacgaactgtatggacgctgcatcagcgagctctaccaatctaatgacgcctatcggcagtccattagctcttgtgatttcacctacctgtttgttgacaacatcatcttctaccagagacctctgaaatccaagaaaagcctcattgataattgcccctatgaagaacattcttacaccgactccaagacaggcgaggtgaagacggctcctgtgaaatgtgtcgctaagagcaaccccctgttccaggaatttcgcctttggcaattcgtgcagaacatccggatttttgagagacagaaaaagatcggcgattccgttaaaaccgacgtggatgtcacaggggagttcattaagtctgccgacgatgtggttagcctgtttgacttcctcaatgatcgcaaagacatcacccaatccgtgctgcttggaacatattttaagatcaagaaaccgaagggcaaagacagcgattacccttatcggtggaactacgtcgaggacaagacctatccctgcaatgagacgagagctctgattctcaaagggctgaaggatgccggaatcgacgaaggcttcctggataaggacaaagagtactctctctggcacattctgtactccgtggaagataagcaggagatcacaaaagccatggaaaagtttgctgccaaaaacagccttgggggcaagttcgcggaggtcttttctagcctgcctcccttcaataagaactatggatcctactctgagaaagctattaagaaactcctggccctgatgcggaccggcaagtattggagcgccgacgctatcgataaacacacccttgaacgcattgacaagatcatcaatggggagtacgatgaatccattagaacacgggtgagagagaaggccatcaacctcaccgacgttagccattttcgcggactgcccctgtggctcgcttgttatattgtgtacgatcggcactctgaatccaaagacatcacatgctggaattgtcctgccgacattgatcagtatctggaccatttcaagcagcacagccttagaaacccgatcgtcgagcaagtggttacggagaccctgcgcacagtgagagatatctggcggcagtacggcaaaattgacgaaatccacattgagatggggcgcgatatgaagaatcccgcggacgtcagagccaaaatgtctaagcggatgatcgataacgaaaatgctaacctccgcattaaagccatgctggctgagttcgccgaccctgattttggaatcgcgggcgtgagaccctactcccctagccagcaggaaatgctgcggatctatgaggagggggcccttgaatccgtggacgaggttcccgatgaaattaatgagatcatttctaagttcaaccaaaccgacatcaagaaacgcccgacacatggcgagattatcaagtacaaactctggctggaacagaagtatcagagcccttacaccggaagaacgatctccctgtctcggctctttaccgacgattatcagattgagcacgtcatcccccaaagccgctacttcgacgattccatgagcaacaaagtgatttgcgaagctgaggtgaatcagctgaaggacagaatgcttggctatgaatttatcaaggcccatcacggggagaaagtcctgctctcttccggagagacagtgaccattctgacagctgaagagtacgaacggctggttcagcttaacttcagaaagaatcctgtgaaaatgaagaaactcctgatggatgacatccccgataagtttattgagcgccagctgaacgacagccggtacatctctaagaaaatcaagtccctcctgagcaatatggtcagagatgaaggcgagcaagaggacatttctaaaaacgtgatcgcctgtaatggggccattaccgatcgccttaagcgggactggggagttaacgatgtgtggaatcatatcattctgcctagattcgaacgcctcaacgctgtcacgggcagcgaccggtttacaaccacatccaccaatgggcacaccatccccgacatgccgctgaacctgcagaaaggcttcaataagaagagaatcgatcaccgccatcacgcgatggacgccattgtgatcgcttgcacaacgcggagccatgttaaccttctcaataacgaggccgccatgtctaaaaacaatgctgtgagatatcagctgtcccggaagctgcgcagatacgaagataccatggtcacacggaacggagagacccgcacaattagcgtggccagagaatttctcaaaccttggcccaccttcaatgcggacgtggagaaggctctgcggggcatcgtcgtttcctttaaacaaaaccttagagtgattaataagacggtgaacaagtatcagaaattcgtctacaatgaggaaaagcacatcaaagagaagaaagccgtgcgccaggaagagagaaacgggagacatctgctcgccatccgcaagcccatgcacaaagatacagtttatggagaggtgaatctgcggagaattaaggaagtctctctgaaggacgctgtggccaaccctaaagcggttgtggataaggaccttaaaaagaaactgatggctatgatcgagctcggctacgatctgaagcagattaccaagtatttcgaagacaataaagatgcctggcaagacgtcaacctcaagaaaatcaaggtgtactactttaccaaagatacaggggaccgctatttcgccacccggtttggaaatgacctggttacacttttcagcaagattacgaaggctgatgacgccaaaaagcagatcgagagaattaccgatacaggcatccagaaaatcctgaagcgccacctcgaagctaacgggggcgactgccagaaagccttttccgcggatggaattgacgagatgaatagaaacatcacccaactgaacggcgggcggccgcataagcccgtgtacaaggtccgcatttatgagaaagccgataagttcgctatcggaacaaaaggcaataaggccgctaaatttgtggaagccgccaaggggaccaacctgttctttgctgtgtaccttaaagagtatgaagactctacgaccggagagacaattaagaagagagtcttcgataccatccctctgaaaacagttatcgaccggctcaagaatggccagacccccgcgcctgaagagaaagatggcgccaagctgctctttgtgctgagccccaacgaccttgtgtacctgcctacagaggacgtcgtgaaaaatgggaccattaaccgccccctcgataagagacggatctataagatggtttcctgtacgggaacagaatgctactacattccgttcatcgtggcttctcctattgtcgacaaagtggagttctttagcctgaataagatcggcagagccatcaccggggaaatgattaaagagatctgtattcccatcaaggttgatcgcctgggaaacattaccgaagtgaataacgagaaaatctga

SEQ ID NO: 4611 - RNA, 4623 nt, synthetic construct
  misc_feature 1..4623: note = Cas9 variant
  source 1..4623: mol_type = other RNA
atgaacaagatcctgggcctcgacctggggaccaatagcattggatgggcccttgtgggcacagatgaggaagggaaccccatcagaatttacaaatccggatctcggatcattcctatgagccaggacgtcctgggcaatttcgatcgcgggaactccatctctcaaacggctgagagaaccagctatcggggagttcgcagactccgggaacgccatctgcttagacgggagcgcctgcacagagtgctccacctgatgggctttctgccgtcccattacgaagaggccatcggctgggacaagggggataataaaacattcgcgaagttttattctgacaccgagcccaaactcccttggcggaagaacgctgaacgcgagcacgagttcctgtttaatacaccctacaacgagatgcttgtggatttcagaaagaatcagcctcagctgtttaaaattaagaaaaacggacaggagagcctcatcccctatgactggaccatttactatctgcggaagaaagccctttccaagcctatcagcaagaaagaactggcctggattatcctcaatttcaaccaaaagcgcggctactaccagctgagaggggaggaagaggaagaaaattctaacaaactgattgagtatcatgctctcacagtcgtgaaggttatcgccgatgaaccgcagaaaggaaagtccgacatctggtacaatgctgagctggaaaacggctgggtgtatcggagaagctctaaaacacccctttttgattgggagtccaaggtcaaggagttcgtggttacgaccgacctgaacgccgatgggagcctcaaagtggacaaggagggaggcgtcaaacgctcttttcgggtgccttccgaggacgattggatgctggtgaagaaaaagacagaaagcgacattgagaagtccgataaaaccgtcggctgctacatctatgacacaattcttcagaatccctctcaaaagatcagagggaaactggttcgcaccattgaacggaagttctacaaaaaggagctcacggaaatcctgaacaagcagaaagagtttcacagcgagctgcagaataaggaactctatcaggagtgtatcaaagaactgtaccctcacaacgaggcgcattacgattcccttctggtgaaggactatacagatctcttcgtgaatgacattatcttctaccaaagacccctgaaaagcaagaagtctcttatttccaactgcccgtatgagtaccgcgtctatcggaatgatagcggaatcgtggaaagagttcctattaaatgtatcgccaagtctcaccccctgtaccaggagtttcgcctctggcagttcatccataacctgcggatttatgaaagacaacgcgaggtgaatggcaaacctgaaaccgacgtcgatatcacagctgagtttattcccaccaccgaggaccgggtgaagctgttcgactggctcaacaataaaaaggaaatcaaacaggatacactgcttcagagctactttaagattaagaaaaagaaaggggacgataagttcccctacagatggaactatgttgaggacaaagaatacccttgcaatgagacgcgggccctgatcctctcccgcctgaccaagctgaacctttctgaagattttctcacaaaggagatggagctggctctgtggcacattctctatagcgtggaagacaaagaggaaatcaagaaagccttcaagtcctttgcgcagaaacacaatctggatgacagcttcgtcgatcaatttatcaagttcccgccctttaagaaagactacggatcttattccgccaaggctattaaaaagctgcttcctctcatgagaatcggcaaatactgggatgagaaggccattagcgggaacacccggtctagaatcctgtccattaacgaacgcctggaggacatgcggagctccggaaagaaaatcgaggatgtgtctgacgacgatatccccaagcaggtccttaagagcttcgacaaagtgaatggcgtttattccggcctcaacacataccaggcttgttacgccgtgtatgggagacattctgaagccagcgagattaccaaatggaagacgcctcaggatatcgacgattacctgaatgagttcaaacaacactccctgcgcaaccccattgtcgaacaggtgatcacagaaaccctcagagttgtgcgggacatttggaagaagtatggagattttagcgaaatccatatcgagctgggccgcgaaatgaaaaatccggctgacaagagagcgaaaatgaccacacagatttctgagaacgaaaataccaaccttcggatgaagtccctgctcgccgagctgaaaaatcacaacgatgtcgagaatgtgcgcccttacagcccctctcagcaagaaatcctgaagatttatgaggaaggggtgcttaactccgttagcgagatccctgaagagattatcaagatcacaaaatctagccagccctcccagacggagctcgtcagatacaagctgtggctggaacagaaatatcggagcccttacaccggagagattatccccctcggcaagctgttcacatctgcttacgaaattgagcatgtgatcccgcaatcccgctattttgacgatagcctttccaataaagtgatttgcgaatctgaggtcaacaagctgaaggggaatctcctgggctacgagttcgtgaaaaaccaccacggagttaaggtggaactgaactttaataaaaccgtcgagatcttcagcattaacgaatatgaggagtttgtgaagggcaattacgggaaaaacagaggaaagatgaagaaacttctcctggaagacatccctaagtccttcatcgagcggcagctgaatgatacacgctatatttctaaagttgtgaagggcctcctgagcaacatcgtcagagaagacggggagcaggaagccacctccaaacatgtgattccctgtacgggaggcgttaccacaatccttaagcaagactgggggctgaatgatgtgtggaacaagattgtcacaccccggtttgagagaatgaatgagctcaccaacacctctctgttcggccagtgggaaaataaagagggaaagcgcatctttcggacggaagtgcctctggagcttcagaaaggcttcaacaagaaaagaatcgaccaccgccatcacgccatggatgctattgtgatcgcctgcgcgacacggagccacgtcacctacctgaataacgaatccagcaaggctaatgccaaagagattagagacgggctcaagcataagctgtgttttaaatctaagacagatgagaccggaaactataaatggcagttccacaagccgtgggacaccttcacacaagatgttcaggacacgctcgaaaacatcgtgatttcctttaaacagaatctgcgcgtgatcaacaagaccacaaatcggtaccagaagtacgaggaagagaaaaagatccttaaaagccaagaaaagggcgattcttgggccattagaaaacccctgcataaggacaccgtcttcgctaaggtgtccctccagaaaatcaagtgcgttaaactggccatggctctgaaggattggaaaaacattgtggacaagcagcttaagaaagagatccgccggctgattctcagctatgggaagtttgacgccgagatcctgaataaatacttcaaggatagaaaatatatttttaaggacgtcgatatctctaaagtggacgtttactatttcgaaacagagtacgtggcgacccggaagaacctcgatacgtcctttgaccgcaagagcatcgaatccattacagataccggaatccagaaaattctgcttaatcacctgggcgtcaagaacaataaccctgagctcgccttcagcgctgaggggatcgacgaaatgaatcaaagaattgtggagctgaacggcggaaaacagcatcagcccatctataaggttcggatgtacgaacctctgggcaataaatttcaagtggggcgcatcggaaacaagaaggataaatacgtcgaggccgctcccggcaccaatcttttctatgccatttaccagtctgaagacaagaaaagaatctatgatacaattcctctgaacatcattatcgagcggcagaagaaagagctctttcccgtgccggaaaataaggaggacaaggataacctgtacaaactcctgttctggcttagccctaacgacatggtgtatctgcccaccgaaaaggagtgggcgaatcctgacctgttcaactttaataacatgaccaaaaatcagagaaagaaactctacaagttcatcgatgggtccggaacgaccgccaactttattcccaatacagtcgctaacatcattttctctatcccgaagaaagacagcggcaagtattccatggggaatcgcattgttcaaaacgaatttggcatcggatctcctcagagcaaaaatcagaaggccttcaccggcgagatgattaaagagcggtgttggaagctgaaaatcaacagacttggggatatcattgaatgcatcaagtga

SEQ ID NO: 4612 - RNA, 4629 nt, synthetic construct
  misc_feature 1..4629: note = Cas9 variant
  source 1..4629: mol_type = other RNA
atggagaagagaatcctgggcctcgacctggggaccaacagcattggatgggcccttgtgaaaggcgaacggcacgagaatgataacgaaacaatcctgtcctacattgaggctgccgggtctcgcatcctccccctggacgcggctgcccagggagatttcgaaaagggcaatcctgccaaaacgcaaaccagcgagagaacacggatgcgcgggatgagacatcttctggagcggtccctcctgcgcagagaacggctgcaccgcgtcctcgacattatggattttctgccgccccattattctcagagccttaccagatacggaaagttcaaagctgacacagagtgcaagctggcctggcggaagaccgaaacaggccactatgagtttctcttccaggattcctttcaggagatgctgcaagacttccagaaccatggcaaacttgaagagaataagaaaatcccttacgattggaccatctattacctgcgcaagaaagctctcacgcagcccgtttctaagcaggaactggcctggattctgctcaactttaatcaaaagagagggtattaccagcgggaggaccaggcggtggatgacaaccagaaaaagcgcgtggaataccaagccctgaaagtcatcagcgtggaggataccggagagaagaaaggcaagaatacatggtatgacgttagacttgaaaacgggctggtgtaccactattccgctcctattaaacccgactggaagggagagaccaaggagttcatcgtcacaaccacgattgatcagaatggcaaacctgaactcgacaaggatgggaaaccgaagtacagcatgcgggcccccaaagaagacgattataagctgcttatggagaagacaaagaaggacatcaccgattctggaaaatccgtgggcgagtacatttatgacgctctgctcgttaaccctcagcaaaagatcagaggcgggctggtgcgcacaatcgaacggtacttttacaaaaaggagctggaaaagattctcctgagccaggagagattcatccccgaacttaccgatcgcgagctgtatcggagatgtgtcgaggaactctacccttctaatgacgcctatcgccacctgattgagtcccgggatatgagataccttctggtggaagacatcctcttttatcagcgccccctgaaaagcaagaaatctctgattgacgattgcccgtacgagtcccggagctatgtggacagagagaccggagaaatcaagtcctctcctgtcaaatgtatcgcgcagagccatcccctcttccaagagtttcgcctgtggcagttcattcacaaccttcggatctaccagaatgaaagatccgttgagggcaagctgcagctcgatgtggacgtgacagaagaggtcctgcctacgcccgagagcaaggccgctctgttccggtttcttaacgatcgcgaaaacgtgacccaagagattctcctgaaagaagttttcaaggggagaaaactgtctgtgaaggactgcccctaccggtggaattatgccggagagggcaaaaagtacccttgtaacgaaacaagacatctcatgctgaaacttctgaagaaggctgggatcgataccgcctttctcacaccggagaaagagcaggccctgtggcacattatgtattccgtcgaagacaaggatcagtacgagaaagctctgagcaccttcgcgcgcaagaatgaccttcccgatggatttaaagaacagttcaagaaggcccctacgtttaaaaaggactatggcgcttactctctccgggccatcaaaaagctgctgcccctcatgagagtgggcgagtattggagcgccgattgcatcgactccgaaacaaaagagcgcatttctcaaatcattagaggggagatggacgaaaaggttagccagcggatgaccaagtcccgcgatagcttcaccgacatctctcagtttcagggactgcctgtgtggcaggcttgttacgtcgtgtacggcagacactccgaggccacagaaattcaacggtgggagaaacccgaggatatcgacgtctatcttaaggcgttcaaacagcatagcctgcgcaacccgattgtggaacaagttgtgctcgagaccctgagagtcgtgcgggatatctggaagacatacgggaaagttgacgaaatccacattgagatgggacgcgatatgaagaatacggctgaagagagaaagcggatctttaaccgcaatcagcagaacgagaatgacaacctgagaattaaagcccttctcaccgagttcatgaatcctgattttgaaatcgaaggcgtgcggccctattctccttcccagcaagaggccctgagaatttacgaagacggggcttggagcggcctggatgaggagaaggaagacaaaaaggagctcgaagccatccgcgagatcctgggaaaattctcccagtctgataaggctaaacggcccacacatagcgaagtccttagatataaggcctggctggagcagcgctactcctctccttataccggcgaggcgattcccctcgccaagctgttcacaccggcttacgaaatcgagcacgtgattcctcagagccggtttttcgacgactcctttagcaacaaagtggtttgcgaagccgaggtcaataagctgaaagatagaatgcttgggtacgagttcatcaaggctcatcaaggagaagtggtgtctctctccggcaccgggcgctgtgcccggattctgagccccgaggaatatgagcagagagtcacggactgctacaaacacaacaccgcgaagatgaagaaactgctcatggaagagatccccgatgactttatccagcgccagatgaatgattctcggtatatttccaagctggtgaaaagccttctgtctaacatggttagagaggaaggagagcgggaagccatcagcaagcacgtgattacatgtaacggcaccatcacagaccgcctcaaaaaggattggggcgtcaatgacgtgtggaaccatattatcctgcctagattccaacggatgaaggatctgaccgggcgcaatgactttgttgctgtgaactcccagggacacgagatcccgagcgtgccccctgaacttcagaaaggcttcaagaaaaagagaattgatcatcggcaccacgccatggacgctatcgtcattgcctgcacgacaagaaatcatgttaacctgctcaataacgaggccgctatgtctgagaataaagcgaaccgcatcgccctgtcccggaagctcagacgctacgaaaattgcgctatttataaagggggagagaccaaaaacatcagcgtggccaaggaatttctgaaaccctgggccacattccctgctgacgtcgagcgggcccttggcgatattgtggtgtcctttaagcaaaatctgagagtcatcaacaaagcgaccaatcactacgaacattataaggacgggaagaaagttaaggtgccccagaaaaagggagatatgtgggtggtccgcaaacctctccacaaggacaccgtgtacgctctggttaacctgcggaacgtgaaaacagtcggccttaaggatgccatcctgatgcccgacagaattgccaataaggatctcaaaaagaaagtgaaggagctgctcgctcagggggacgatctgaaaaagatcaagaaatacttcgagacggaaaaggacacctggcaggatgttgacgtgaaaaagattgaggtctattacttttctgaagagacagccaaccattattacgcgacccgcaaaccgttcgatgctaatgtgaagatcgacagcgttacagacaccggcattcaaaagatccttagacggcacctggaggaaaacggaaataaagccgatgtggccttctcccctgagggcatcgctcgcatgaacgaaaatatttttagactcaacgggaataagcaccatcagcccatctataaagtccgggtgtacgagaaggccaacaaatatcctgtgggacagacgggcaataaggcttctaagttcgtcgaagccgcgaaagggacaaacctgtacctggccgtttacgagagcgaggtggtggacaagaaaaccgctgaaatttccaagaaacgctcttatgtcatcgtgccccttagagatgccgttgctcggcagaagcaaggagtgccggtcgcccctgagagaaatgaagagggcgggaaactgctctttgtgctgagccccaaggacttcgtttacgtgcctaccgaagaggagcgctccaagggcgaagtcctcctgccccttgataaaaaccggatttatatcatgatggacgccagcgatggaatcgtgaattttctgccctactctgtcgctaacctgatttatgcgctccctaaggaccaggcctccggcttctgtacagatgggagaatgatccagaacgagtttggactgggcagcccgaaatctaagaatgaacgcgctcttaccggggagatgattaaagaaatctgcctgcccgtgaaggttgaccggctcggaagaattacagagatcaacggcaataaggtgtga

SEQ ID NO: 4613 - RNA, 4644 nt, synthetic construct
  misc_feature 1..4644: note = Cas9 variant
  source 1..4644: mol_type = other RNA
atgaagaaaatcctgggcctcgacctggggaccaacagcattggatgggcccttacaaataacgatttcgacaataagctgggctccatcgaggggctcggatctagaattatccccatgagccaggatgtgctgggcaaatttgactccggggtctctattagccaaacggctgaacggaccaagtaccgcggaacaagacggcttgttcagcgcttcctgctcagacgggagcgcctgcacagaatcctgaacatcctcgattttctgcctcggcattattccgaagccattgacttcgataaaaagtttggccagttcaagccggagcgcgaagagaaactttctttttacaagaatgagagcggcaaaaaccagttcctgtttctcgaatcccaccaagagatgttcagcgaatttaagctgacccatcccgaccttaaacaggtgccttatgattggacaatctactatctgagaaagaaggcgctcacccagaaaatttctaaggaggagctggcttggatcattctgaatttcaaccagaaacgggggtactatcaactccgcggagaagaggaagaggtgaataagaacaaactggaagagtttcacacacttgtcatcgtggacgttattgagagagaaaagggcaaatccggggtgtggtacaatgtcatcctggagaacggatggatctacaagcgggaaagcaagattgccctcttcgattggatcggcaaacagaagaatttcattgtgaccacggagctgaacgacgatgggaccatcaaacttaataaggacaacgaagagaaacgctcttttagatcccccaaggaggacgattggggactgcggaagattagaacagaacagaccatcaaccagagcgagaaatctgttggctccttcatctatgacgaactcctgaagaaacctaatcaaaagattaaaggcgagctggtgcgcacaatcgaacggaagttttacaaggatgagctcagcaaaattctgaaggcccagatcaccttccattatgagattcttggggacagaaacatctacaaaaagtgcatcgatgaactgtatcgccacaatgactcccacaaaaacaatattaaggataagggatttgactacctcttcctggatgacatcattttctatcagcggccccttaaatctaagacgagcctgatctccgattgtagcctcgagttcgtccctattaaagacaagaaaggcatcctggtgaaggactctaacgggaaacaagtggtcaagccgctgaagtgcattgctaaatccaatcccatctttcaggaatttagactcctgcagtttgttaagaaccttaaaatctacaagaaagagattatcaatgagattgatgtgacaaacgactacctgaagaccgaagaggatctcgtggaactgttcgactggctgaatgataaggccgagatcagccagaaacaatttcttgcttatcctaagttcaaactcaaggaagacaaataccgctggaacttcgtcgaggataagatttatccctgtaatgagacacggaaccagtttctgaatgccatcgcgaagatcgacgtgaacaaatctttctttgatgccaagaacacccaggacctgtggcatattctctacagcgttaccgataaaacagaactgttctccatcaatacggagaccggcattcagtctggagctcttagcacatttgccaagagacacaacctgtccaatgagttcgtgagcaacttttctaaaatcaagccttataataaggactacgggtcctatagcgaaaaagctattaagaaactcctgcccctgatgcgcttcggatctaactggaataagaacaatatcgatgccaaaacccttgcgcggatcgacaagctccaaacaggcgaatttgacgagaccatgagaacgcgcgtccgggagaaagccattcatctgtccaagatcacagatttccagggcctgccgctctggctggctagctacattatctacgacagacactccgaagcctctaacattagcaagtggaaaacccctgaggatatcgcttggtttcttaatcccaagaacaaatccgggttcaagcagcactctctgcggaatcctatcgtggaacaggttattaccgagacactccgcgtggtcaaagacatctggcaacattatggagaaggcaaggagaactttttcaatgagattcacatcgaactggggagagagatgaagaacaacgccaatgatcggaaaagaattaccgaaacaatcaaccagaatgagaacacgaatctgcgcattaaggccatccttaccgagctcaaaaacgacggaatcaatgatgtgcggccctacagcccctcccagcaggaaattctgaagatctatgaggaaggcgtctacaacagcgagattagaaaagaaaagctggaggacatcgataagattcgcaaaaatgctaagcctacaccgtctgagatcatcaaatataagctctggctggaacaagggtacatttccccctataccggcaaacttatccctctgagcgacctcttcacaaccaagtaccagattgagcatatcattccccagtctagactgtttgatgactccctgagcaacaaggtgatctgcgaatctgaggttaatgatcttaaaggaaacaatacggcgctcgagttcatcctgaagaacgaaggccggattgtgctgctcaccgggggaaaaacagtcaagatctttaccaaagaggcctacaatcaacacattacaagctattacatcaagaacaagtccaaacagaagcgcctgcttaccgaagagattcctgaaaaattcatcgacagacagctgaacgacacgaagtatattagcaaaatcgtgaagaatctcctgtctaaaatcgttcgggaggaagatgagcaggaggtgacatccaagcatattgtcagcctgaacggctccatcacctctcgcatgaagcaagactgggggcttaatgatgtgtggaacaaaattgtgagccccagatttgaacggctgaatgctatcacaaactccaatgacttcggaaagctcgagctgaaaaaggatgaatttggcaacgccgggaaacaggttttccagaccaccgtcccggacgatattgccaagggcttttctaagaaacgcatcgaccacagacaccatgctctcgatgccctggtgatcgcgtgtattaatcggacacacatcaactaccttaataacctgaatgctaaggacgagaacgataaaacgattaagcatgagctccgcaataaactgtgcttcaagaccaagcctgacagcaacggaaattccaaatgggaatttcacaagccctgggagaacttcacaaagaaggtggaagacgagctgaaccagaccatcatttctttcaaacaaaatacaagagtcatcaacaagaccgtgaataagtatcaggtttggaaagaagaggatggcgccatgaagaaagtgacggtcaagcagacaaaaggggacaactgggccatccggaagcctattcacgctgagaccgtgagcggaaaagtttttcttaagagaatcaagcagtcccatattaccatcgccaatgctattgaacaaatcgagctgattgtggataaagaagtccgcaagcagctcaaagccaagatcaaacagtaccccaacaataaggagggcttcaagaaacacctgaaggcgtttcctatcatgattaacgggaaagccatcgacaaggtgcaaatttatgaaacaatcgaggctaccgccacacgggagagaaataacctcgatattacgttcgacgagaaaaagatcgaaaagatcaccgatacaggaatccagaaaattctgcttaatcatctgaagcaggaaatttaccagaacgctatcgacgagagcggcaaaaagattgcgccccacgaagttgccttttctgagatcgggatcgatgagctcaataaaaacattaaggtgctgaataacggcaagaaccatcaaccgatcaaaaaggtccgcattttcgaagagtccaaacggtttagcctgggacagtctggctccaagaccgacaaatacgtggaaacagccaaggggaccaatcttttctatgctatctacgagggcaaaaagggaaacagaaattataagacgattcctctgaacgaggtgatcgaacgccagaaacaggggctcaatagcgccctggtcaccgatgagaacgaaaatcggctcctgtttacactttctcccaacgacctggtttacattcccaccaatgaggaaaagaaaaacctgacaaccatcaatttcgataagctctccagagagcaaacagagcgcatctataaatttgtgagctgtacctccggagaaggccacttcgtgagcaacaattactctaaggagattatcagcaacgaaaatgggtccaacaacaagaatgagcggatgctggaatttaacaattctaacacgatttatgacgagaaagagaagcctgtcatgatcaaaagcgtgtgctggaaacttgaagttgacagactgggcaaaattaagcggatcatccgctga

SEQ ID NO: 4614 - RNA, 4677 nt, synthetic construct
  misc_feature 1..4677: note = Cas9 variant
  source 1..4677: mol_type = other RNA
atgaagaaaatcctgggcctcgacctggggaccaacagcattggatgggcccttgtgaatgtcgataagaacggcaatcccttcgggatcgagggactgggctccagaattatccctatggaccaggctacactctctgattttgaaaaagggaacagcaagtcccaaacggccgagcggaccatgttccgcggagcgagacggctgcgcgaaagaaaacaccttcggcgcgagagactgcatcggattctcaatgaactgaactttctgccgatccactaccgctcttgcatcgacttcgttcatagactcggcaagtttaaggctaatcacgagcccaaaattgcctggcggagcaacgatcaggacaagatggagttcatctttcaaaattccttcctggaaatgatgtctgattttacaaaacgccagcctgagcttgtgaaggaaggcaaaaagattccctatgactggaccatctacttcctgagaaagaaagccctcgggcaacggattgagaaggaggaactggcttggcttctgctccattttaaccagaaacgcggatattaccagctgagaggcgaggatgaaatcgacgccacacggagcgctaagaccagaaaatatttcgatcgcaagattatcaaatccatcattgacacaggggaggaatacaagggactgaaggtgctcatcgtcgagctggataatggcaaccaggggaaaatttttaagcaagaggtgcctgactgggttggacaggaaaagaatatcattgccaccgtggaccttgataaggacggcaaagatcggttcgacaagggcgtcctgagccagagattctctatcccctccgatagcgagtgggaaacggagtggaagctcatcaaactgaagaccgaagaggaccttgaggcgtctcagaaaacagtggggacctatatttacgattccctgctcaagaaccctaatcagaaaatcaagggaaagctggttcgcacaattgaacggaaatactatagagacgagctgcgcgccatcctcaacaagcagcgggaatttcacccggagctgaacgataaaaagctgtaccagcactgtattttcagcctttatccccaaaatgaggcttttagaaactctatcgccaataaagacttcacctacctctttctggaagatatcattttctatcagcgccctcttaagtccaagaaaagcacgatcaacaattgcgcttacgaggtgcggagatatatggacaaggaaacaaaagagctgaaggaagtccccctcaaatgtattgccaagtcccatcctatctttcaggagttccgcctgtggcagtttatttctaacctgcggatctacaaaaaggacattaccgatatcgacgtgacaaatgatttcctccacagccaagacgattacgcgaacctgtttgagtggcttaataacaagaatgaaatcgaccagaaagccttcctgaagtatcccgcttttggcttcaaaaaggatgccgtgaactacagatggaattatgtcgaggacaaatcctacccgtgcaacaagacccggagcgctattctctctaagctggataaacatgaacaggagttcctgaccaaggaacttgagctcaaaatctggcagctgctgtattccgttaatagcaaggaggaaattgacaaagccctcaacgtgaactctcctaagatcaataacaagattagcatcgatcacacagggatcctgcacgagcttaaatcctctagcctgtccgacattagcatccaacgcctcaaggccattaattttgaagagaaagattacggatcttattcctacaaggctatcaaaaagctgctggcgcttatgagacagggcaagtacttcgacaacacggccattaccgacgctacaaaagcccggatcaatagcatctttgatagactcgaatctatttccttcgaccccgagcgcatcaacagcatttccgatgacgatatccctaagcagattctgaaatcttttatcaagctgaatcggacctatgggggattcaacacataccaggcctgttatgctgtgtacggcagacatagcgaggccaaagaaatcgcgaagtgggagaaacccgaagacattgatcaatatctcgctaagtttaagcagcactccctgcgcaatcccatcgtcgagcagattatcaccgaaacgcttagagtggttcgggacatttggaaaaagcatgcctacaaaacaatcaacaaggataatcagggcaacaattgcgagtctgagagcgaactgaccgagattcacatcgaactcgggcgcgacatgaaaaacaataagtccgagagactgcggatcagccgcattaactctgagaacgaaaataccaacctgagaatccggaaacttctcattgagttcaatgatcctgaatttggagtggagaacgtccgcccgcattcccccagccaacaggaaatcctgagaatttatgaggacggcgtgctgaaatctggggttgagatccctgaatacgtggataatatcattaagaaattcaaggagacagacgtcaaaaagcagccctccaagagcgaagtgctccggtacaaactgtggcttgagcaaaagtatcgctctccttacaccaacgaagtcatccccctgggaaaactctttacaaatgactatcagattgagcacatcattccgcagagcagatacttcgatgactcctttagcaacaaggtgatctgtgaggccgaagttaatcagctgaaagagaacgaactgggctgcgagttcatcatgaataacgggggccggattgtggaactttctttcggaaagacggtcagaatcctcgattttgaggcttatgagcaattcgtgcagcagaattacgccggcaaccgccctaagctgcggaatctgctcatgaccgaaattcccaacgactttatcgatagacagctgaacgactcccgctatattagcaaagttgtgaaggggcttctgtccaatatcgtccgggaggatggagaagctgagtctacaagcaaaaacctcatttcctgtaccggcggggtgacagccagactgaagatggactggggactgaatgatgtgtggaacaatcttatctaccctcgcttcgagcggctgaacgaactcaccaattctaaccaatttggctactgggacaaaaaggatgggaagaatgttttccagacgcaggtccccatggacatccagaaaggctttaacaagaaaagaattgaccaccgccatcacgcgctggatgccctcgtgatcgcttgcgccacccggagccatattaattatctgaacaatgagtccgctaagtctaacagcaaagaatccagatacgaccttcggcgcaagctgagacggctcgaggtgatccaaaaagaatatacaattaatggacgcaaggagatcagaaacatcgaggtcgccaaggagttctacaaaccttggaatagctttacccaggatgcgcagtctgccctggaaaacattgtggtttccttcaagcaaaacctgcgggtgatcaataaaacaaccaactattttcttagattcaataaggaaggcaaaaagattttcgagacgcagacaagcgggtctaactgggctatccgcaagcccctgcacaaagacaccgcctttggactcgtcaatctgaagcggacaaaaaccgtgtccctcgctaacgccattctggattacgaccagatcgttaatagaaaactttggaccaagatcaaggaactgattagcatcggctatgataacaagcgcattctcaaatacttcacagacgataaggagaattggaacgagatcatttcttccgggatcgaagtgttttactatacggacaatttcgagaaacaggtcgccacccggaagccgctggataccagctttacagaatccaaaattatcaacagcatcacagacctgggcattcacaagatccttctggctcatctcagagcgaatgagggaaaccctaatattgccttctctcccgaagggatcgagaccatgaaccgccacatttgtgagctgaacggcggaaagtttcatcaccccatctacaaagtgcgggttcatgaacctctcggctataagttcaaagtgggggataagggaaatagaagcacgaaatacgtcgaggctgccaagggcacaaacctgtttttcgggatctatattaattcccaaggaatccgctcttacgaaaccattccgcttaacgtggccatcgagagacagaaacagggcctgagccccgtgcctgacaataacgagctgggggaacggctcctgttttggctttcccccaatgacctggtctatctccctacctctgatgaggttgaaagcggcatttgctgcaacaagctgggaatcgaccgcatctacaagatggtgtcctgtacaggctacgtgggggatttcattcccgctcacatcgccaatcctattatccagaccctcgagctgggatctaacaataaagcgcaaagagcttggacaggcgaaatgattaaggagatctgcattcccgtcaaagtggaccggatggggaacatcgttgagatctttaatcgcaacaagaattga

SEQ ID NO: 4615 - RNA, 4695 nt, synthetic construct
  misc_feature 1..4695: note = Cas9 variant
  source 1..4695: mol_type = other RNA
atggccaagatcctgggcctcgacctggggaccaacagcattggatgggctatcgtggatgacaaaaattccaagattcttgatacaggcgtcagaatcttccccgagggggttgtggccaaaacgattggatctggcgacaaggaagagagcaaaaacgcgaagcggcgcgaatccagacagacccggcgcgggttttacagaaagcggctgcgcaaaatcaagctcctgagaacacttatcaatttcaaaatgtgccctctggagcactttgaactcgatgtgtggtctaagtgggacaaaattaagaagaaagagggacggatggctccggagctgttcctgcccgaaaacagcgcctataatctctggctgaagcaaaacccttacatccttcgcgataaagccctgtccaaggacctcaccctgacagagtttggcagagtcctttatcatctgattcagcggcgcggcttcctctctaatagaaaagggaaggatgacggaaaaatctacggcgggaaggaaggaattgtgggcatcgataagaccaacgagcagattaaaaatagcacactggggaagtttctgttcaaaatcctccccaaggagggagaaccttttaaaatcattgaggacgaactgggcaacgagcttcgggttcgctccagatataccctgcgggatatgtacatcgctgaatttgaggccatttggaatagacaggctaagcacctcggcctggacaacatctattacagcaatgtgaagaacgtccttctgaaagggtctctcaagaataaaaagaacgagcgcaaaattaaccatctgaagaagatcaaaggaaatggcaacatcgaaattatcacgctgaataacaatctctccaagaacgagaaacccaagtacctgcttaaaattgccaccaagctgcctctcaaggaatttctggcggggcggatcgagaaagacgaagatggaaagattaaattcaagagcaatgagtctgtgcttttctggcaaagaccgctgcgctcccagaaaaagctcctggccaaatgtcggttcgagcccgacctgaaggatgacaacggcaagttcatccagaaagggaagacaccttgccacctcagccatcccctgtatgaagagtacagagcttatcagtacgttaataacatcgaatatggcaaaaagcaacgccttgaggaatctcagcggaaacaggtgattgatctgatcaattccaaggacggaaactttaagttcagcgagattaaaaagaaactcaagctgtcctacgagacctttaattattctgatgacagctccgtcaacggcaattacatgatcaaaaacctgaacagcattttccctaaggaaatccttgagaaggaatttgtggtgaatgtcaacaaagaggatattatcgagtacgggtatgaaagaatctggcacctcttccacttttgtgaggacaatgatgttctgattaagaaactgcaggacaacttcgacctctctgaaaatgatatcgagaagatttccaaaatcaacctgaaggaaggatacagcaatgtgtctcttaaggccattaaaaacatcctgccctatctcaaggagggcaaactgctgagcgacgctgtgatccttgggggagtccgcaatgtgtttggcaagaaatggcatgagttcattgattttcacgaaaagatcgagaaagacattctctacatcaaccatcaaaagtccaataaggaaggggaggccattgagaaaatcaagaaatatctgatcgattacaagttcggctttacagaaaacgacaatcggttcaaaaagctgtatcaccactctcaggatgttgtggaggtcaagctccagaaaaagattggaccggtggaagacctgagaaaccctatcgttcaacagggcgtgaatgaggtccgccggcttgtgaacgaactgctcgatgtccatgggaaattcgaccaggtgagagttgagctgggacgggatctgaagaacaataaaagcaagcgcgaagagattggctacaagatcagagagaacaccgcgaaaaatgaaaaggccaaagagcttctcattgaatacgggctgcggcagtccagagacaacgtgcaaaaggtcctgctctttcaggagatgctggatcgcggaacggtggctgtttgcccctatacaaataaaaccatcaacatcagcgacgtgcttggcaatgagaacaagatgcagattgaacacatcattcctaagtctatctccctggacgatagcttcgccaataaaacactctgtgactctaagtttaacgggctgaaaggcgagcggaccccctacgagttctatcagattaataacgatgctaatctgtggggaggctccaagagctgggaagaaatcgagagacgcacctttcggattcttccctactccaaagccaagagattcacatctaagacgaaatttgagaccaacgacttcatccaacgccagctcaatgatacaagatatatcagcaagaaaaccaaggaaattctgtcccagatctgcgaggacgtccgggtgatgcctgggtctctgacagccgaactccgcaaactgtggggacttaacaacattctgcatccggcttttgtgctcgatctgcccgcgctgcacatcgacgccaataagcatattcctcactacgttgtccttgatgaggacaacgtgcccatcctgagccagagaatctataatgataaacctattctcaaggctaaccaaacctccatcacgggcttcgtggacaatgaaatttttaagagcaaagagaagtacgtcaaattcgaggtgaaggcccccaacctgtctaatggggaatactgggccaaactcctgctttccaacccgaaaagcatcgttcgggtgtttaaggagaaacctaagtctacagaaaatgagattgtcgtgcgcggaaaaatcgaaaaggagaaattcaagcacgagggcctgtccgggatcaacgctgaaggcaaggagaatggaacctattgggccaaactcagcattgttgataagaaattcaagaaacccaagaaggacgaccagcctaaaaagaacggcaaacagatcctgctgtttggggcggtgaaggaaggagtcttctctagctacatgtatgagtgtgatgctgaccttgaggatggcaaatactggctgattctcgacatcgattttgaaaatgtggagttcgaaaaggccctgaacgagagacccgaagttctcgagaatcagattctgatccaagggattaccaacgacgagaatgtgtttgtctccgatatggactgccagcatcagttccttatgaacgaaggaaaaggcaagtattacgtgctgtttgatatcatcagcgaggtgaacgagttctatcctattaagacaaaatctcccgaactcgaaaatgggcaatccctgaccgagggcacaatctgggtcgacaagtacacgggagagattaaatttgatccgaagaaaaaccgggaagaccaccgccatcacgccatcgacgctctggttattgcccttaccaaggagacatacttccagcagctgagcagacggaatgcttcctctgaaaacaagaaaagaggcaatgagtatgaaaaggagcagctcgattttgccgagccttggaaagagttccacgtggacgcgcaaaagagcatcaactccatcctgatttctcataaacagaataagaacatcctcaccaagattacaaagaagatcaccaaaaatgggaagacgtacaaaagcgaaggaatgtccgtgcgcggccagctgcacgataagacctattacgggcataacaagaattgtaaagccgacgaatatgtctaccgggtggatattaacaatctttctttcagccagctgacaaacatcatcgacctgaatctcaaggctgttattgtggagggagtcatcaaaaagtttgaggaatccgagaaactgcttttcaagaaaatgaacagcaaggtgcaaaacctggataagtctaaagttaagaaaattaaggccaaagtggacaagatcctcaaggaaacctcctttttcatgcccaatgagggcaaaagatatattcgcctgaacatcattgaacccgctaattttgagcggatgcctgtcccgatcaagaaagtgagaatccgcaaggttctccggaacgccgagaaactgaataacgaaattaagcagttcgtggatccccagaataaccaccatgtccttatctacaaggacgagaatggcaacctgaaagaagaggtggtgacattttggaccgtcgttgaaagaaagcgcacgggggagcctgtgtacaaactgcccagcgatggaaagaaaattgtgacaaccctccagatcaatgacatgttcctgcttggcctgaacgaggatgaaattaattgggagaaccctaattataaccacctcaaggaacacctgtaccgggtccaaaagtttacatctggggacttctattttagaatcgcgaaaacctccagcatccagaacggagaggaaaagcagcaaattaattctttcggcctcgggaaaaacggatggctgacccataatcccatcaaggtgaaaatttccgttagcggcaagatccttaaggtgtga

SEQ ID NO: 4616 - RNA, 4713 nt, synthetic construct
  misc_feature 1..4713: note = Cas9 variant
  source 1..4713: mol_type = other RNA
atggagaacagcaataactcctctaagaaatactatctgggcctcgacatggggaccgatagctgcggatggtgtgtgacagacgataagtacaatatcattagatcccacaaaaagatctatggccccgacgggaaactggtcaagcgggaaggatgccatctttggggctctcgcctgttcagacctgccaacacggctaagagccggcgcctcaatagaaccgcccggcgcagactggcgcggcgcagacggcgcattatccttctgagagagctctttcagccggaaattgataaagttgaccccaacttctttcggcgcctggatcaatccaatctgtggaacgaggacaaggataaagaactccagatggagcacaatttcctgtttaacgacaaggatcttacagacaaagagtactataaggatttccctaccatctaccatctgagaaaggctatggtgaatgggctcacaatcaacggatattactacgaccccaaaaagcagtttgacattcgggaagtgtatctggtccttgcccacatgatcaaatacagaggcaatttcctgatggagggcgatgtgaaggactctgttgtggatcctacctatctcaaacagtgttttgacaacattgatgtcatcctgattagcctgaataacggggaagacgatgagaacgaggacgataagatcgacccctccgaatgctgtttcaatgtggatgagaaaaaggcccgcaagctcgctaacaattttcaagaaacaaacaaagttagcgacctggaggacgatgaacgggaccttttcggaaagtttaattctaaagatattagaaagaaaatcctgaagctcatcaacggcgggtccggagtgaagctgaaagacttccttcctaaggagattctggtcgcccatgatggcgacgatgagtacggggacaaaaagatcgatctcagctctgaaaccctggaggacgatattaatggatattccctgccggaaagctacgtggagatcattctcgaagctaaaaagatctatgacttcaagacgctggcctaccttctgcacggcaaatctctcctgtgcgatgcgatggtgaacgtctacgaggagcacaaggaacagcttgccgctctgaaacgcctctataagaaatacgccaccaaggagcagtattactttatgttccgggactccagaatcctggacggcgatgacagcgatgacgaagaggataaggaagagtccaataaagaggaatctaaggacaaaaagaaaaaggctagctatgtttcctacattgggtatacaaaaaccaacagcaaggccaagtacacaggagcgcatatcacctctgagaaaaatatttccgccctgatcaagcagattaaagatgacctcaagtttgatgacctgaaaagcaaggtggatgacccctctcaacagaacgaacttagcgatgaggacaagctggacatccagtgtatcgaggaagctattgagtccaatacgttcctccctcgccagaactctcggaataacggcgcctttccctaccaactgaacctgaatgaaatgagaacaatcattgagaaccagagcaaatattaccctttccttaaggataaagctccctcctttccggacgggaagaccgaagagtataaaatcgtgagcctcctgaagttcaagattccttactatatcggacccctgtctcagcctaatgattacgtccgcgacgataaacgggacaaccactgggtgcaatttagaggcgagaataaccaggggattatcaatccctggaacttctcccagatcgttgatctcgaaggaacagccgacaagtttattagcaatctgaccaactattgcacctacatcttcggcgagaatacacttcccaaagaatctctgatttttcaggcctacaaggtgctcaacgatctgaataacctgaaagtcaatggctcccttatcagcaaggaggacaaggattatattatccaaaacgtgtacctcaaaaagaaaaagatcaaagggaaggacattgttaacgctctgaaaaataagtataagctgtccgacgaagatcctacggtgaccacaaaaggatctggcaagagcatcggggaggacgaggtcgatctcaccatgttcaactcctctctgagctccttcattgacatgagcgatccgaatgcgtttggacccgagttctacaaagactctaacaagtttgaacttgccgaaaaagtgatcgagctgattacaatcgtcgaagataaggacctcctgaaggagcgcctgaaaaagctcggcctttccgataatcaggtgaactatctgttcaaacagaagtacagcgggtgggctcctctgtctcggaaactcctggacggcatcaccattgattgtgttaatgagaacacgggagaagcctatcccgtgacaatcattgacgtcatgagagatacccctcttaattttatggagatctacgaaaccaaggagtcccagttcagcggctttaaggagaaagtggccgaactgaacgacgagaagaaactctctcgggacgatctgattgaagagagctacgcttcccccgccatgaagcgcagcgttagacaaacattcaaagtgatcgacgaactgaagaatacccttaacatcgatcattttgaccggattttcgtcgaggcgacaagagctccgggggaggccggaaagatggtgaaatctcgcaagaaacagctccaggaagcctatgatgctgccaaggacctggtggatcaggagtcccgggacgatctgcaaaaactcagagacgatctggaaaagcagacggacgatcagcttcgcagaaagaaagtttacctgtattttatgcagctcggccggagcgtctactccggggagaagatcgacctgaatgaactggacaaaaactatgatattgaccacatcattcctcaagctaaacttaaggatgactctttcaataacatggtgctggtggagcgcgagctcaacaataagaaacaggatgaataccccatccctagcaccattatctccgagcacggaagaaactggatccagaagctggccaagattcaagacaaaaataagcggtcttattttatgcccaaagataaggcgaaccgcctcctgagacctgaaagcaaacagcttacatccgacgagctgaatggcttcatcaaccggcagctcaccctgacaaatcagtctgtcaaggccgtgtgcgatattctgaagatgaccgaaaaagggagcgagatcgtttactccaaggctaacttcgtgagcgactttcgcaaactttgtggcgagctgagaccctcttacgatgccttcgtcaaggtgcgggacattaatgactttcatcacgctaacgatgcctatctcaatatcgttgtgggaaacgtctactatgaaaaattcaagaatttttacatcaacaatcgcattgactatgataacaatggcaagaaagacctgtccgtgctcgcgagcaagctgttcacgaaaacccaagccgatgacaagacagggaacatctactgggaggctagatttcataacgaaaaagagaccgattctaatggaaaggagcggacaattaaggttagagacgaaggcaccgagtccacgttcgataaaatcgaatattacatggagcttaacgacccgctggtgacacagatgcagtacaccctcagcgggaagcagggatttttcaaaaagattacactgaaaaccaaggccaaagataatgaagacaactctgataagctgtttcctcttaagcaatatctgcgctccgacagcaataaagtcatggacgtgaacaagtacggcgggtattccgatatgatcaccccctacttcatgctcgtgcagagcgagggcaaaaagggaaaacacatctattctctggagagcattcccacaatctacctcaagtccttcaagaaaaaggaagaggacattatcaattatctgtcttgcaaaaacaaacttaagaatcctgtcgttattagcgataagctgctgatgcggacgatcgtgaagattccgtactttaaaaacgactccaatctctctctggtgaaacttggcaccagcgggagaacaggaaacaatatcatctacattaacctgtccgaactcatcctgcccattgagtggaagaattattaccgcaagatctctaacctcctgggcaccaacgtcagctccacaaaacctaaggatcttagcaagttcaccgaacagatgaaaaatgaccccacgtctacactggtggatgggtccaacaaggttgagcatgacaaaaataaccggtttttcagctatctgattaataacgtgatcaataagcctatctttgagggactccccaaaacctcttgctccttcattaagctggaaagcaaatacgatgagttttgttcccttaacaccctggaacaggctaagatcattgccacaatcattaagctcctgtcttgcaaaagcgtccaaggctgtaagctctccaatctgagcgggcttccttcttccctgggcgccctgatcagcaacaaagctctcaccgagggaacaatcatttctaaggaaagctcctgcggcctgaaagagaatatcattttcgtggttcccaacgactga

SEQ ID NO: 4617 - RNA, 5067 nt, synthetic construct
  misc_feature 1..5067: note = Cas9 variant
  source 1..5067: mol_type = other RNA
atggagttcaagaaagtgctgggcctcgacatcgggaccaacagcattggatgcgccctgctttccctgcccaagtctatccaggattacggcaaagggggaagactcgaatggctgacaagccgggtcattcctcttgacgctgattatatgaaggcctttatcgacggcaaaaatgggctgccgcaagttattacgcccgcgggaaagcgcagacagaagcggggctcccgcagactcaaacaccggtacaagctgcgcagatctcggctgatccgcgtgttcaaaaccctcaactggctgcctgaggattttccccttgacaatcctaagagaatcaaagaaacaattagcaccgagggcaagttctcctttcggatctctgattatgtgcccattagcgacgaatcctaccgcgagttctatagagagtttgggtaccctgaaaacgagatcgaacaggtcattgaggagatcaatttccggcgcaagacaaaaggaaagaacaaaaatccgatgattaagctgctccccgaagattgggtggtttattacctgagaaaaaaggctcttatcaaacctaccacaaaggaggaactgatccggattatctacctctttaaccagagacgcggcttcaagagctctcggaaagacctgaccgagacggccattctggattatgacgaatttgccaagagactcgctgagaaagagaagtactccgccgaaaattatgagaccaaattcgtgagcatcacaaaggtcaaggaagtggttgagctgaaaaccgatgggcgcaagggaaaaaagcggtttaaagtgattcttgaagactctagaatcgagccctacgagatcgaacgcaaggagaagcctgactgggaaggcaaagagtatacattcctggtcacccaaaagctcgaaaaagggaagttcaaacagaacaagcccgatctgccgaaggaggaggactgggctctttgtacgacagccctggataatcggatgggatccaaacatcctggcgaatttttctttgacgagctcctgaaggcgttcaaagaaaagagaggctacaaaattcgccagtatcccgtgaaccggtggagatacaagaaagagctggagtttatctggaccaagcagtgccaactcaatcctgaactgaacaatcttaacattaacaaggagatcctgcgcaaactcgccacagtgctgtaccccagccagtctaagttctttgggcccaaaattaaggaattcgagaattccgatgtccttcacatcatcagcgaagacattatctattaccagcgggatctgaaatcccagaagtctctcattagcgagtgtagatatgagaagcggaaaggaatcgacggcgaaatttacgggctgaagtgcatccctaaatccagcccgctgtatcaagagtttcgcatttggcaggatatccataacatcaaggttattagaaaagaatctgaggtgaatggaaagaagaaaatcaacattgacgaaacccagctctacatcaatgagaacattaaggagaaactgttcgaactttttaattccaaggatagcctgtctgagaaagacatcctcgaactgatcagcctgaacattatcaattccggcattaagatctctaagaaagaggaagagaccacacaccggattaaccttttcgctaatagaaaggagctcaaagggaacgaaacgaagagccgctatcggaaagtgtttaagaaactgggattcgacggcgagtacatcctgaatcatccctccaagctcaacagactgtggcacagcgattactctaatgactatgccgataaggaaaaaaccgagaagtccatccttagctctctgggctggaaaaaccgcaacgggaagtgggagaaatccaagaattacgacgtcttcaacctccctctggaagtggctaaggccattgcgaatctgccccctcttaaaaaggagtatggaagctactccgccctcgctatcagaaaaatgctggttgtgatgcgggatggcaagtattggcaacaccccgaccagattgccaaagatcaggaaaacacatctctgatgctctttgacaagaatctgatccagcttaccaacaatcaacgcaaggtcctgaacaaatacctcctgacactggctgaggtgcagaagagaagcacccttattaaacagaagctcaatgaaatcgagcataacccgtataaactggagctggtttccgatcaggacctcgaaaagcaagtgctgaagtctttccttgagaaaaagaatgaaagcgattacctgaaagggctcaagacgtaccaggccggatatctgatctacggcaaacactccgagaaggacgtccctattgtgaacagccccgatgaactgggggagtatatccggaagaaacttcctaataactctctccgcaatcccattgtcgagcaggtgatcagagaaacaatttttatcgttcgggacgtgtggaagtccttcggcattatcgacgagatccatattgaactgggacgcgagctgaaaaacaacagcgaagagagaaagaaaacctctgagtcccaggaaaagaattttcaagagaaagaacgggcccgcaagctcctgaaggagcttctgaacagctctaatttcgagcactacgatgaaaacggcaataaaatctttagctccttcaccgtcaaccctaatcccgacagcccgctcgatattgagaagtttagaatctggaaaaaccagtctgggctgacagacgaagagctgaataagaaacttaaggatgaaaagattcctaccgagatcgaggtgaaaaagtatatcctgtggctcacacagaaatgtcggtccccctacacgggaaagattatccccctgagcaaactcttcgactccaacgtttatgaaattgagcacatcattcctagatctaagatgaagaatgatagcaccaacaatctggtgatctgcgaacttggcgtcaacaaagctaagggggaccgcctggcggccaattttatctccgagtctaacggaaaatgtaagttcggcgaagtggagtacacactcctgaaatacggggattatctgcagtactgcaaggacacctttaagtatcaaaaagctaagtacaaaaaccttctggccacagagccgcccgaagatttcattgagcggcagatcaatgacaccagatatattggccgcaagctcgccgaactgctcacgcctgtggttaaagatagcaagaacatcattttcaccatcggatccattacatctgagctgaaaatcacctggggccttaatggggtctggaaggacatcctgcggcccagatttaagcgcctcgaaagcattatcaacaaaaagctgattttccaggacgaggatgaccctaataaataccattttgatctgtccatcaacccccaacttgacaaggagggactgaaacggctcgatcacagacatcacgctctggacgccacaattatcgcggctaccacgcgcgaacatgtgcggtatctcaatagcctgaacgccgccgataatgacgaggaaaagagagagtacttcctttctctgtgtaaccacaagatccgggattttaaactgccttgggagaatttcacatccgaagtgaagagcaaactcctgtcttgcgtcgtgtcctacaaggagagcaaacccattctttctgacccgtttaacaagtatctgaagtgggaatacaaaaatggcaagtggcagaaagttttcgctatccagattaagaacgatcgctggaaagccgtgagacggtccatgtttaaggagcctatcgggaccgtctggattaagaaaatcaaggaagtgagcctcaaagaggctatcaagattcaggccatctgggaggaagttaaaaatgaccccgtgcgcaagaaaaaggagaagtatatttacgacgattatgcgcaaaaagtcatcgccaagattgtgcaggaactgggactctccagctctatgagaaaacaggacgatgagaagctgaacaaattcatcaatgaagctaaggttagcgccggcgtgaacaagaaccttaatacaaccaacaaaaccatttacaatctggaggggcggttttatgagaagatcaaagtcgctgaatacgtgctgtacaaggccaaaagaatgcctctcaacaagaaggagtatatcgaaaaactgtcccttcagaagatgttcaatgacctgcccaacttcattctcgagaaatctatcctggataattacccggaaattctcaaggagctggagagcgacaacaaatatatcattgaacctcacaagaagaataaccccgtgaatcgccttctgctggagcatatcctcgaataccacaacaatcctaaagaggcgttttccacagagggcctggaaaagcttaacaaaaaggccatcaataaaattggaaagcccatcaagtatattacgcggctggatggcgacatcaacgaggaagagattttcagaggggctgtctttgaaaccgataaaggatctaacgtttacttcgtgatgtatgagaataaccaaacaaaggaccgcgagtttctcaaacccaatcctagcatctccgtgctgaaggccatcgaacataaaaacaagattgatttctttgctccgaatcggctcggcttctctagaatcattctgagccccggggaccttgtctacgtgcctaccaacgatcagtacgttctgatcaaagacaattccagcaacgagacaattatcaattgggacgataacgaatttatttctaatcgcatctatcaggtgaagaagttcaccggaaactcctgttactttctgaaaaatgacatcgccagcctcattctgtcttattccgccagcaacggcgtcggggagttcggctcccagaatatctctgaatacagcgtggatgacccccctattcggatcaaggatgtttgcattaaaatcagagtggaccgccttggaaacgtcagacccctgtga

SEQ ID NO: 4618 - RNA, 3924 nt, synthetic construct
  misc_feature 1..3924: note = Cpf1 variant
  source 1..3924: mol_type = other RNA
atgacccagttcgagggctttacaaacctgtaccaagtgagcaagacgctcagattcgaactgatcccccaggggaaaacccttaagcacattcaggagcagggatttatcgaagaggacaaagcccggaatgatcattataaggaactgaaacctattatcgaccgcatttacaagacatatgctgatcaatgcctccagctggtccagcttgactgggagaacctgtccgccgcgatcgattcttacagaaaggagaaaaccgaagagacacggaatgctctcatcgaggaacaggccacctatcgcaacgccattcacgactacttcatcggcagaacagataatctgaccgacgctattaacaagcggcatgccgagatctataaagggctgtttaaggctgaactcttcaatggaaaagttctgaagcaacttggcacggtgaccacaaccgagcacgaaaacgccctgctccgcagctttgataagttcacaacctacttttccgggttctacgagaatagaaagaacgtgttttctgcggaagacattagcacggccatcccgcatcggattgtccaggataatttccccaagtttaaagagaactgtcacatcttcacacgcctgatcaccgctgtgccttcccttagagagcacttcgaaaatgttaagaaagccattggaatctttgtgtctacaagcattgaggaagtcttctcctttcccttctataaccagctgctcacccagacccaaatcgacctgtacaatcagctgctcggcggcattagccgggaggctgggacagaaaagatcaaaggactgaacgaggtgcttaacctggccatccagaagaatgatgagacggcgcatattatcgcctctctccctcaccgctttattcccctgttcaagcaaatcctttccgacagaaacaccctgagctttattctcgaagagttcaaatctgacgaagaggttatccagtccttttgcaagtataaaacactgctgcggaatgaaaacgtgctcgagaccgctgaggccctgttcaatgaacttaacagcatcgatctgacacatatttttatctctcacaagaaactcgagaccatttccagcgctctgtgtgaccactgggatacgcttcgcaatgccctgtacgaaagacggatctccgagctcacaggcaagattaccaagtctgccaaagagaaggtccagagaagcctgaaacatgaagacatcaacctgcaggagattatctccgctgcggggaaggaactcagcgaggccttcaaacaaaagacctctgaaatcctgtcccacgctcatgccgcccttgatcagcctctgccgacaaccctcaagaaacaggaggagaaggaaattctgaaaagccagctggactctcttctcggactgtatcaccttctcgattggtttgctgtggacgagagcaatgaagtggatcccgagttctccgcccgcctgacaggcatcaaacttgaaatggagccttctctgagcttctacaacaaagcgcggaattatgctacgaagaagccctactccgtcgagaaatttaagctcaacttccaaatgcctaccctggccagcgggtgggacgttaataaagaaaagaacaatggagccattctgtttgtgaaaaacggcctttactatctcggcatcatgcccaagcagaaagggagatacaaggctctgtctttcgagccgacagaaaagacctccgagggatttgataaaatgtattacgactatttccctgacgccgctaagatgattcccaaatgcagcacacagctgaaggccgtgaccgcgcattttcagacgcacaccacacctatcctcctgtctaacaatttcatcgaaccccttgagattaccaaagagatctacgatctgaacaatcccgaaaaggagcctaagaaatttcaaacagcctatgctaagaaaaccggcgaccagaaggggtaccgcgaagccctctgtaaatggattgatttcacgcgggactttctgtccaagtacacaaagaccacaagcatcgatctgtcctctcttagaccgagctcccagtataaagacctcggagagtactatgctgagctgaaccccctgctctaccacatttctttccagcgcatcgccgaaaaggagatcatggatgcggtcgaaaccggcaaactgtatctttttcaaatttacaataaggacttcgccaaagggcatcacggaaagcctaacctgcataccctctattggacaggcctgttcagccccgagaatctggctaagacgtccatcaaacttaacggccaggccgaactcttttaccggcctaagagcagaatgaaacgcatggctcaccggctgggggagaagatgctgaataaaaagctcaaagatcagaagacccccattccggacacactgtaccaagagctttatgattacgtgaaccacagactgtctcatgacctctccgatgaagcccgcgccctgctgcctaatgttatcaccaaggaggtgagccacgaaattatcaaagaccggagattcacatctgacaagtttttctttcatgtccccatcacccttaactatcaggctgccaattcccctagcaaattcaaccagcgggtgaatgcgtacctgaaggagcaccccgaaacgcctattatcggaattgatcgcggcgagagaaacctcatctatattacagttatcgactctaccgggaaaattctggagcagcggagcctcaacaccatccaacagtttgattaccagaagaagctggacaatagagaaaaagagcgcgtggctgcccggcaggcctggtccgtcgtgggaacaatcaaggatcttaaacaaggctatctgagccaggtcattcatgaaatcgtggacctcatgattcactaccaggctgttgtggtcctggagaacctgaatttcgggtttaagtctaaaagaaccggcatcgccgaaaaggcggtgtaccagcaattcgagaagatgcttattgataaactgaactgcctcgttctgaaggactatcccgctgagaaagtgggaggcgtcctcaatccgtaccagctgacagatcagtttacgtccttcgccaagatggggacccaaagcggattcctgttttatgtgcctgccccctacacatccaaaatcgaccccctgaccggcttcgtggatccttttgtttggaagacaatcaagaaccacgaatctcgcaaacatttcctcgaggggtttgacttcctgcactatgatgtcaagaccggagactttattctgcatttcaaaatgaatagaaaccttagctttcagcggggcctgccggggttcatgcccgcttgggacatcgtgtttgaaaagaatgagacgcagttcgatgccaaaggcaccccttttattgcgggaaagcgcatcgtgcccgtcattgagaaccacagattcacaggccggtaccgcgacctctatcctgctaatgaactgatcgccctcctggaggaaaaggggatcgtgttcagagatggatccaacattcttcccaaactgctggagaatgacgattctcatgccatcgacaccatggttgctctcattcggagcgtgctgcagatgcgcaactccaatgccgctacaggcgaagattacatcaactctcctgtcagagaccttaacggggtgtgttttgatagccggttccaaaatcccgagtggccgatggacgccgatgcgaacggagcctaccacattgctctgaagggccagctcctgctcaatcacctgaaagagtccaaggaccttaaactgcagaacgggatcagcaatcaggactggctggcctatattcaagaactccgcaactga

SEQ ID NO: 4619 - RNA, 3903 nt, synthetic construct
  misc_feature 1..3903: note = Cpf1 variant
  source 1..3903: mol_type = other RNA
atgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccaatgatattcctacaagcatcatttaccggatcgtggacgataaccttccgaagttcctggagaataaagctaagtatgaatctctcaaagacaaggcccccgaggctatcaactacgaacagattaaaaaggatctggccgaggagctgacctttgacatcgattataagacatccgaagtcaatcagcgcgtgttcagcctcgacgaggttttcgaaattgcgaactttaacaattacctgaaccagtccggcatcaccaaattcaatacgattatcgggggaaagtttgtgaacggcgagaataccaaaagaaagggcatcaacgaatatattaatctttactctcaacagatcaacgataaaacactgaagaagtataaaatgagcgtcctcttcaagcagattctgtccgacaccgagagcaaatcttttgtgatcgacaaacttgaggatgactccgatgttgtgacaaccatgcagagcttctacgaacaaattgccgcttttaaaacggtcgaggaaaagtctatcaaagagacactgagcctcctgttcgacgatctgaaggcccagaagctcgacctgtccaaaatttactttaagaatgataaatctcttaccgacctgagccagcaagtgttcgatgactattccgtgatcgggacagctgtcctcgaatacatcacccagcagattgcccctaagaacctggataatcccagcaaaaaggagcaggagcttatcgcgaagaaaaccgaaaaggccaaatatctgtctctcgagacaattaagctggctctggaagagtttaacaaacaccgggacatcgataagcaatgtcgcttcgaggaaattctcgccaattttgctgccatccctatgatcttcgacgagattgcccagaacaaggacaatctggctcagatctccattaaataccagaaccaaggaaagaaagatcttctgcaggcgagcgccgaagacgatgttaaggctatcaaagacctcctggatcagacgaacaatctgcttcataagctcaagattttccacatctctcagtccgaggacaaagccaacatcctggataaggacgaacatttttatctggtgttcgaggagtgctactttgaactcgccaatattgtgcccctgtataacaaaatcagaaattacattacccaaaagccttacagcgatgagaaattcaaacttaactttgaaaattccacactggctaacggctgggacaagaataaggagccggataacaccgccatcctcttcattaaggacgataaatattacctgggggtcatgaataagaaaaacaataagatctttgacgacaaagcgatcaaggaaaacaagggagagggctataaaaagattgtgtacaaactgcttcccggggctaataagatgctccctaaagttttcttttctgccaagagcatcaagttctataacccctccgaggatattctgcggatccgcaaccactctacacacaccaaaaatggaagccctcagaagggctacgaaaaatttgagttcaacattgaagactgtagaaagtttatcgatttctataaacagtccattagcaagcatcccgagtggaaggacttcggctttcggttctctgatacgcaacgctacaattccatcgacgaattttacagagaggtggagaaccaggggtataaactgacattcgaaaatatcagcgagtcttacattgattccgtcgtgaaccagggaaagctctatctgtttcagatctacaataaagacttcagcgcctattctaagggccggccgaaccttcacaccctgtactggaaagctctctttgatgaacgcaatctgcaagacgttgtgtataagctgaacggggaggccgagcttttctacagaaagcagagcattcctaaaaagatcacccatcccgctaaagaagccattgcgaataagaacaaagataatcctaagaaagagtccgtctttgaatacgacctcatcaaggacaagcggttcacagaggataaatttttcttccactgccccatcaccattaactttaagagctctggagccaataaattcaacgacgaaatcaacctgctgctcaaggagaaagctaatgatgtgcacattctgtccatcgacagaggcgagcgccatcttgcctattacacactggtcgatgggaagggaaacattatcaagcaggacacgtttaatatcattggcaacgatcggatgaaaaccaattatcacgacaagctcgctgccatcgaaaaagatagagacagcgcgcgcaaggattggaaaaagattaacaatatcaaggagatgaaagaaggctacctgtcccaggtggttcatgagattgccaagctggtgatcgaatataacgctattgtcgtgttcgaggaccttaattttgggttcaaacggggaagatttaaggttgagaaacaagtgtaccagaagctcgaaaagatgctgatcgagaaactgaactatctcgtcttcaaggataatgaatttgacaaaacaggcggggtgctgcgcgcctaccagcttaccgctcccttcgagacatttaagaaaatgggaaagcagaccggcatcatttactatgtgcctgccgggttcacgtctaaaatctgtccggttaccggctttgtcaaccaactgtaccccaagtatgaaagcgtgtccaagtctcaggagttcttcagcaaatttgacaagatttgctacaatctcgataaaggatatttcgagttttccttcgactacaagaactttggcgataaagccgctaaggggaagtggacaatcgcgtctttcggaagccggctgattaattttagaaactccgacaaaaatcacaactgggatacccgcgaagtgtatcctacaaaggagctggaaaaacttctgaaggactacagcatcgagtacggccatggggagtgtatcaaagccgctatttgcggagaatctgataagaagttctttgccaaactcacctccgtcctgaacacgatcctccagatgcggaatagcaagacaggcaccgagctggactatcttatttctcccgtggccgatgttaacgggaatttctttgactccagacaagctcctaaaaacatgccccaggatgccgacgcgaatggcgcttaccacatcggactgaagggcctcatgctgctggggcgcattaaaaacaatcaggaaggaaagaaacttaacctggtgatcaagaatgaggaatatttcgagtttgtccagaaccggaataactga

SEQ ID NO: 4620 - RNA, 1341 nt, synthetic construct
  misc_feature 1..1341: note = Cpf1 variant
  source 1..1341: mol_type = other RNA
atgaagcccgacatcaaagatagagagtacatgtatcggctgattatcggccaactcttctacgacgggcaccagcagattgccgtgaacctggctaatacccttggatgcagcgcccctccgccccctccctccgataagctgtttcgcctcgtcacaatcgcgaaacagttcgttgaagaccctgattataaggctgaggaaaacacgatgcccatgcagtttgagacctctagcgccggcctggaccttcaatacgatgccgacgtggctgccacatcccctgaaccgtctcagtatgagaccatttacctgacagtgcataaagctccctgtagagccgcggccttcaatagcgatgggtccctcatcgctaccggatctgccgactgcagcatcaagattatggatgtcgagcggatcctggctcgcgaaaaggagcacagagaaatgaacgagaatggccctgacgcccatcaccccgtgattcggacactgtatgatcatgttgacgtgcgcagagactttgggcggttctccgataaaatcctcgactttcaggatgtcaacaccgtgattttccaccctcgcgacgcgatcctgattagcggatctaatgataagacggttaaactttttgacttctccaagaccgccgtgaaaagagctatgaagacactgagcgaggtctaccccgtgcgggccctctcttgtcacccgggcggcgaatttctgcttgtggctaccgatcatcctacagtccgcctgtacaacatcgagaccgcccaggcctatgcttccgcgaatcccgacgatcaacacagagaaagcgttacggacgtgcattactctgagaacgcccggctctatgtgacagcttccaaggatggggacgtcaaagtgtgggacggagttagctcccgctgcgtggaaaccttcaagagagcccacgatggctctagcatctgttccgccaaatttacaaagaatgggaaatacattctgaccagcggaatggactctatcgtcaagctgtgggagctctccaccaaccggtgcctgattgtgtatacaggcgctggggccacgggagcgcaggattaccctaccagcgcttctttcaatcagaacgaggacttcgttctttttcccgatgagaaaagcggctccatgtgttcttgggaagccagaaatgccgaccgcaagcggctgctcgctctgggccacacaagcgcctgcagaaccttcgtgcattcccccagcatgcctgcttttatgacagggtctgatgaccaccgcgcccggttctggtatagaaagccgaccacgaacgataactga

SEQ ID NO: 4621 - RNA, 1293 nt, synthetic construct
  misc_feature 1..1293: note = Cpf1 variant
  source 1..1293: mol_type = other RNA
atgaagcccgacatcaaagatagagagtacatgtatcggctgattatcggccaactcttctacgacgggcaccagcagattgccgtgaccctggctaacacacttggatgcagcgcccctgcgccgcccccttccgataagctgtatcgcctcgtcacgatcgctaaacagtttgttgaagaccccgattacaaggccgaggaaaaatctctgcctatgcagttcgagaccgtgagcacaggccttgacctggaatatgatgccgacgtgcaacccgtctcccctgagccgtctcagtacgagaccatttatctcacagtgcataaggctccctgtagagccgctgcctttaatagcgatgggtccctggttgcgaccggatctgccgactgcagcatcaagatcatggatgtggaacggattctggctcgcgagaaagaacacagagagatgaacgagaatggccctgacgcccatcaccccgtcatccggacactctacgatcatgtggacgacgttaacaccgtgctgttccaccctcgcgatgctattcttatctccgggagcaatgacaagacggtcaaactgtttgatttctctaagaccgccgtgaaaagagcgatgaagacactctccgaagtgtaccccgtccgggccctgagctgtcacccgggaggcgagtttcttctggttgctaccgaccatcctacagtgcgcctctataacattgaaaccgcccaggcttacgcctctgccaatcccgatgaccagcacagagagtccgtgacggatgtccattatagcgaaaacgctcggctgtacgtgacagcgtctaaggacggcgatgttaaaatctgggacggggtgtccaatcgctgcgtcgagaccttcaagagagcccacgatggaagcgctatttgttccgccaaatttacaaagaacggcaaatatctgctcacctctgggatggacagcatcgtgaagctgtgggagctttccaccaatcggtgcctgatcgtttacacaggagccggcgctacgggggcccaagactatgcgaccagcgcttctttcaaccacaatgaagattacgtgctctttcctgacgagaaatccggaagcatgtgttcttgggatgcccgcaacagcgacagaaagcggctgcttgccctgggccatacatccgcttgcagaaccttcgtccactctcccagcatgcccgcctttatgacaggctccgatgaccatcgcgctcggttctggtacagaaagcctgccaccacggataattga

SEQ ID NO: 4622 - RNA, 3690 nt, synthetic construct
  misc_feature 1..3690: note = Cpf1 variant
  source 1..3690: mol_type = other RNA
atggccgctagcaagctggagaaattcaccaactgctactccctctctaagacactgagatttaaagccatccccgtgggcaagacgcaggaaaatattgacaacaaacggcttctggtcgaggatgaaaagcgcgcggaggactataagggggttaaaaagctcctggatagatactatcttagcttcatcaatgacgtgctgcactccattaaactcaagaacctgaataactacatctctctgtttcggaaaaagacccgcacagaaaaggagaataaagagctcgaaaacctggagattaatcttagaaaggaaatcgctaaagccttcaagggagccgctggctataaaagcctgtttaagaaagatatcattgagaccatcctccctgaggccgctgacgataaggacgaaattgccctggtgaactccttcaatgggtttacaaccgcgttcacaggatttttcgataaccgggagaatatgttttctgaagaggccaagagcacctccatcgctttccgctgtattaacgaaaatcttacgagatacatcagcaacatggacatttttgagaaagtcgatgccatcttcgacaagcatgaggtgcaagaaatcaaagagaagattctgaactctgattatgacgttgaagacttctttgagggcgagttctttaatttcgtgctcacccaggaagggatcgatgtctacaacgctattatcggaggctttgtgacagagtccggcgaaaagattaaggggctgaatgagtacatcaacctgtataatgccaagaccaaacaggcgctcccgaagttcaaacccctgtacaagcaggttcttagcgaccgggaatctctgtccttttatggagagggctacacaagcgatgaagaggtgctcgaggtcttccgcaacaccctgaataaaaactctgaaatcttttccagcattaagaaacttgagaaactgttcaagaattttgacgaatattcctctgccgggatcttcgtgaaaaacggacctgctattagcacgatctccaaggatatttttggcgagtggaatctcatcagagacaaatggaacgccgagtacgatgacatccacctgaagaagaaagctgtggtcacagaaaagtatgaggatgaccggcgcaagagcttcaagaaaattgggtctttctccctggaacaactccaggagtacgccgatgccgacctgagcgttgtggaaaaacttaaagagatcattatccagaaggtggacgagatttacaaggtctatggatctagcgaaaaactgtttgatgctgacttcgtgctcgagaagtccctgaaaaagaatgatgcggttgtggccatcatgaaagaccttctggattctgtcaagagctttgaaaactacattaaggctttctttggcgagggcaaagaaaccaatagagacgagtccttctatggggattttgtgctcgcctacgacatcctgctgaaggttgatcatatctatgacgccattcggaactacgtgacacagaaaccctatagcaaggataaattcaagctctactttcaaaaccctcagttcatgggaggctgggacaaggataaagagaccgactaccgcgctaccatcctgagatatgggtctaagtactatcttgccattatggacaaaaagtacgcgaaatgcctgcagaagatcgataaggacgatgtcaatggaaactatgaaaagattaattacaagctcctgcccggccctaacaaaatgctgccgaaggtgtttttctccaaaaagtggatggcttattacaatcccagcgaggacatccagaaaatctacaagaacgggacatttaagaaaggagatatgttcaatcttaacgactgtcacaagctcattgatttctttaaagactctatctcccggtatcctaagtggagcaatgcctacgatttcaacttttccgaaacggagaaatataaggacattgccggcttctacagagaagtcgaggagcaaggctataaggtgtcttttgaaagcgcttccaaaaaggaggttgataaactggtggaagaggggaagctgtacatgttccagatctataataaagacttttctgataagagccatggaacccccaacctccacacaatgtacttcaagctgctttttgacgagaataaccacggccagattcgcctgtccgggggagccgaactcttcatgcggagagctagcctgaaaaaggaggaactggtcgtgcatcctgccaattctcccatcgcgaacaaaaacccggacaatcctaagaaaaccacaaccctttcctacgatgtttataaggacaagcgctttagcgaggatcaatacgaactccacatccccattgccatcaacaaatgccctaagaatattttcaaaatcaacacggaggtgcgggtcctgctgaagcatgacgataatccctatgtgattggcatcgacagaggggagcgcaacctcctgtacatcgtggttgtcgatggcaaaggaaatattgtggaacagtattctcttaacgagatcattaataacttcaatggcatccggattaagacagactaccactccctgctcgataagaaagaaaaggagagatttgaagctcgccagaactggaccagcatcgagaatattaaagagctgaaggccgggtatatctctcaggtggtccacaaaatctgtgaactggtggagaagtacgacgctgttattgcccttgaagatctcaacagcggattcaaaaattcccgggtgaaggtcgagaagcaagtgtaccagaaatttgaaaagatgctgatcgacaaactgaactatatggttgacaagaaaagcaacccctgcgcgaccggcggggccctcaagggataccagattacaaataagttcgagtcttttaaatccatgagcacccagaacggcttcatcttttatattcctgcttggctgacatccaagatcgatccgtctacggggttcgtgaatcttctgaaaaccaagtacacaagcatcgccgactccaaaaagtttatttctagcttcgatagaatcatgtatgtccccgaggaagacctctttgagttcgctctggattacaagaacttttcccgcaccgacgccgattatattaaaaagtggaaactgtactcttacggcaatcggatcagaattttcgccgctgcgaagaaaaacaatgtgttcgcctgggaagaggtttgtcttacaagcgcttataaggagctctttaacaagtacggaatcaattatcaacagggcgacatccgggccctgctgtgcgaacagtccgataaagccttctacagctcttttatggctctcatgtccctgatgcttcagatgcgcaacagcattaccgggagaacggacgtggatttcctgatctctcctgtcaaaaattccgacggaatcttttatgatagccggaactacgaggcccaagaaaatgcgattctccccaaaaacgctgacgccaatggcgcctataacattgctagaaaggtgctgtgggccatcgggcagttcaaaaaggcggaggacgaaaaactggataaggtgaagattgctatctctaataaagagtggcttgagtacgcccagacctccgtcaagtga

SEQ ID NO: 4623 - RNA, 3903 nt, synthetic construct
  misc_feature 1..3903: note = Cpf1 variant
  source 1..3903: mol_type = other RNA
atgagcatctaccaggagttcgtgaacaagtattccctgtctaaaaccctcagatttgaactgattccccaaggcaagacacttgagaatatcaaagcccgggggctgattctcgacgatgaaaagcgcgctaaagactacaagaaggccaaacagatcattgataagtatcaccagttctttatcgaggaaatcctgagctccgtctgcatttctgaggaccttctgcagaactacagcgatgtttatttcaaactcaagaaatccgacgatgacaatctgcaaaaggattttaagtctgcgaaagacacgatcaagaaacagattagcgagtacatcaaggattccgaaaaattcaagaacctgtttaatcagaacctcattgacgctaaaaagggacaggagagcgatctgatcctttggctgaagcaatctaaagacaatggcattgaactcttcaaggccaactccgacatcaccgatatcgacgaggccctggagattatcaagagctttaaggggtggacaacctatttcaaaggatttcatgaaaatagaaagaacgtgtactcttccgatgacattcctacaagcatcatttaccggatcgtggatgacaatcttccgaagttcctggagaacaaagctaagtatgaatctctcaaagataaggcccccgaggctatcaattacgaacagattaaaaaggacctggccgaggagctgacctttgatatcgactataagacatccgaagtcaaccagcgcgtgttcagcctcgatgaggttttcgaaattgcgaattttaacaactacctgaatcagtccggcatcaccaaattcaacacgattatcgggggaaagtttgtgaatggcgagaacaccaaaagaaagggcatcaatgaatatattaacctttactctcaacagatcaatgacaaaacactgaagaagtataaaatgagcgtcctcttcaagcagattctgtccgacaccgagagcaaatcttttgtgatcgataaacttgaggacgattccgacgttgtgacaaccatgcagagcttctacgaacaaattgccgcttttaaaacggtcgaggaaaagtctatcaaagagacactgagcctcctgttcgatgacctgaaggcccagaagctcgatctgtccaaaatttactttaagaacgacaaatctcttaccgatctgagccagcaagtgttcgacgattattccgtgatcgggacagctgtcctcgaatacatcacccagcaggttgcccctaagaatctggacaaccccagcaaaaaggagcaggatcttattgcgaagaaaaccgagaaggccaaatatctgtctctcgaaacaatcaagctggctctggaggaatttaataaacaccgggacattgacaagcaatgtcgcttcgaggagatcctcgccaactttgctgccattcctatgatcttcgatgaaatcgcccagaataaggacaacctggctcagatttcccttaaataccagaatcaaggaaagaaagatctgctccaggcgagcgccgaggaagacgtgaaggctatcaaagatctgctggaccagacgaacaaccttctccatagactgaagattttccacatctctcagtccgaggataaggccaatattctggacaaagatgaacatttttatctcgtgttcgaggagtgctactttgaactggccaacatcgtccccctttataataagatccggaactacattacccaaaaaccttacagcgacgagaagttcaaactgaattttgaaaactccacactcgctaatggctgggataagaacaaagagccggacaataccgccatcctgttcattaaggatgacaagtattacctgggggtgatgaacaaaaagaataacaaaatctttgacgataaggcgattaaagaaaataagggagagggctataagaaaatcgtttacaaacttctccccggggctaacaagatgctgcctaaggtgttcttttctgccaaaagcatcaagttctataatccctccgaggacattctgcgcatcagaaaccactctacacacaccaagaacggaaatcctcagaaaggctacgaaaagtttgagttcaacattgaagattgtcggaaatttatcgacttctataaggagagcatttccaaacatcccgaatggaaggatttcggctttcgcttcagcgacacgcagagatacaattctatcgatgagttttaccgggaggtcgaaaaccaagggtataagctcacattcgagaatatttccgaaagctacatcgactctgtggttaaccagggaaaactgtatctttttcagatctacaataaggatttctccgcctatagcaaaggccgcccgaacctgcacaccctctactggaaggctctgtttgacgagagaaatctgcaggatgtggtctataaacttaacggggaggccgaactcttctaccggaagcaatctattcctaagaaaatcacccatcccgctaaggaggccattgcgaataaaaacaaggacaatcctaaaaaggaaagcgtgtttgagtacgacctgatcaaagataagagattcacagaagacaagtttttcttccactgccccattaccatcaactttaaatccagcggagccaataagttcaacgatgagatcaacctgctcctgaaagagaaggctaatgacgtccacattctttctatcgatcgcggcgaacggcatctggcctattacacactcgtggacgggaaaggaaacattatcaagcaggatacgtttaatattatcggcaacgacagaatgaagaccaattatcacgataaactggctgccatcgagaaggaccgcgattccgcgcggaaagactggaagaaaattaacaatatcaaggaaatgaaggagggctacctgagccaggttgtgcatgaaattgccaaacttgtcatcgagcacaacgctattgtggttttcgaggatctcaattttgggttcaagagaggacgctttaaagtggaaaagcaggtctatcaaaaactggagaagatgctgatcgaaaagctcaactacctggtgttcaaagacaatgagtttgacaagacaggcggggtgcttcgggcctatcagctgaccgctcccttcgaaacatttaaaaagatgggaaaacagaccggcattatctactacgttcctgccgggttcacgtccaagatctgtccggtcaccggctttgtgaaccagctctatcccaaatacgagtctgtgagcaagtcccaagagttcttctctaagtttgataaaatttgctataatctggacaagggatacttcgaatttagcttcgattataaaaactttggcgacaaggccgctaaagggaagtggacaatcgcgtccttcggatctagactgattaattttcgcaacagcgataagaatcataactgggacacccgggaggtctaccctacaaaagaacttgagaagctgctcaaagattattccatcgagtacggccacggggaatgtattaaggccgctatctgcggagagagcgacaaaaagttctttgccaagctgacctctgtgctcaacacgatcctgcagatgagaaattccaaaacaggcaccgaacttgattacctgattagccccgttgccgacgtgaacgggaatttctttgattctcgccaggctcctaagaacatgccccaagacgccgatgcgaatggcgcttatcacatcggactcaaaggcctgatgctgcttgaccggattaagaacaatcaggaggggaaaaagctgaacctcgtcatcaagaatgaagagtacttcgagtttgtgcagaacagaaataactga

SEQ ID NO: 4624 - RNA, 1071 nt, synthetic construct
  misc_feature 1..1071: note = Cpf1 variant
  source 1..1071: mol_type = other RNA
atgaagaccaactaccacgacaaactggccgctatcgagaaggatagagaaagcgcccggaaagactggaagaaaattaataacatcaaggagatgaaggaaggctatctctcccaggtggtccatgagattgcgaaactggttatcgggtacaatgctattgtggtgttcgaagatcttaactttggattcaagcgcggcagatttaaagtcgagaagcaagtgtatcagaaactggagaagatgctcatcgaaaagctgaattaccttgttttcaaagacaacgagtttgataaggccgggggagtgctgcgggcctatcagctcacagctcccttcgaaacgtttaaaaagatgggcaaacagaccgggatcatttactatgtccctgccgacttcacatctaagatctgcccggtgaccggatttgttaatcaactgtaccccaaatacgagagcgtgtccaagtctcaggagttctttagcaagttcgataaaatttgttataacctggacaagggctactttgagttctccttcgattataaaaattttggcgacaaggctgccaaagggaagtggacaatcgcgtctttcggaagccgcctcattaactttagaaattccgataagaaccacaattgggacacccgggaagtctaccctacaaaagaactggagaaacttctgaaggattatagcatcgaatacggccatggggagtgcattaaggccgctatctatgccgagaacgacaaaaagttctttgctaagctcacctctatccttaattccattcttcagatgcgcaacagcaaaacgggaaccgaactggactacctcatctctcccgtggccgatgtgaacggcaatttctttgactccagacacgcgcctaagaacatgccccaggatgccgacgctaatggggcctaccatattggactgaaaggcctgatgctcctgtatcggatcaagaacaatcaagatggcaaaaagctgaacctggtcattaagaatgaggaatacttcgagtttgttcagaaccgcaataaaagctctaagatctga

SEQ ID NO: 4625 - RNA, 3792 nt, synthetic construct
  misc_feature 1..3792: note = Cpf1 variant
  source 1..3792: mol_type = other RNA
atggaggactacagcggcttcgtgaacatctattccattcagaagaccctgagatttgaactcaaacccgtcgggaagacactggagcacatcgagaaaaagggattccttaaaaaggataagattcgggccgaggactacaaagctgttaagaaaatcattgataagtatcatcgcgcctacatcgaagaggtgtttgactctgtgctgcaccagaaaaagaagaaagataagacgagattcagcacccaatttatcaaagagattaaggagttctccgagctctattacaaaacagaaaagaatatccctgacaaagagcggctggaggcgctttctgaaaagctgcgcaagatgctcgtcggcgcttttaaaggggagttcagcgaagaggtggccgaaaagtataaaaacctgttttccaaggagctgattagaaatgagatcgaaaaattctgcgagaccgatgaggaacggaagcaggtttctaactttaagagcttcacaacctactttacaggattccattccaatcgccagaacatttacagcgacgagaaaaagtctaccgccatcggctatagaattatccaccaaaatctcccgaaattcctggataaccttaagatcattgaatccatccagcggcgctttaaagacttcccctggagcgatctgaagaagaatctcaaaaagattgacaaaaacatcaagctgacggagtacttttctattgatgggttcgtgaatgtccttaaccagaaaggaatcgacgcttataataccatcctgggcggcaagtccgaagagagcggggaaaagattcagggactcaacgagtacatcaatctgtatagacagaaaaacaacattgaccggaagaatctgcctaacgtgaaaatcctctttaagcaaattctgggcgatcgcgaaacaaaatctttcatccccgaggcctttcctgacgatcagtccgttcttaatagcatcaccgagttcgctaagtacctgaaactcgacaagaagaaaaagtccattatcgccgaactgaaaaagtttctttctagcttcaacagatatgagctggatgggatttacctcgcgaatgacaactccctggccagcatctctacatttctgttcgatgactggtcctttattaaaaagagcgtgtctttcaagtacgatgaaagcgtcggagaccccaaaaagaaaatcaagtcccctctcaaatatgagaaggagaaggaaaaatggctgaagcagaaatactataccatttctttccttaatgatgctatcgagagctactccaagagccaagacgaaaaacgggtgaagatccgcctggaggcctattttgctgagttcaagtctaaagacgatgccaagaaacagtttgacctcctggaaagaattgaggaagcgtacgccatcgtggagccgcttctgggcgctgaatatccccgggatagaaacctcaaggccgacaaaaaggaggtcgggaaaattaaggatttcctggactccatcaagagcctgcagtttttcctcaaacctctgctttctgctgaaatttttgatgagaaggacctgggattctacaatcaactcgagggctactatgaagagatcgattccatcggccatctgtacaacaaagttcgcaattatctgacggggaagatttacagcaaagaaaagtttaaacttaacttcgaaaattccacactcctgaaaggatgggacgaaaaccgggaggtggccaatctgtgtgtgatctttagagaggatcagaagtattacctcggcgtcatggacaaagaaaacaacaccattctgtctgatatccccaaggtgaaacctaatgagcttttctatgaaaagatggtttacaagctgattcccacaccgcacatgcagctccctcgcatcatctttagctccgacaacctgtctatttacaatcccagcaaatccatcctgaagattcgggaggccaagagcttcaaggaggggaaaaacttcaaacttaaggactgccacaaatttatcgatttctataaggaatctatttccaaaaatgaggactggagcagatttgatttcaagttttctaaaacctccagctacgaaaacatctctgagttctatcgcgaagtggagcggcagggatacaatctcgactttaagaaggtcagcaaattctatatcgattccctggtggaggacggcaagctgtacctctttcaaatttataacaaagatttcagcatcttttctaaggggaaacctaatctgcataccatttacttcagatcccttttcagcaaggaaaacctgaaagacgtttgtctcaagctgaatggagaggctgaaatgtttttccgcaagaaatccatcaactacgatgagaagaaaaagcgggaaggccaccatcccgagctgtttgagaaacttaagtatcccattctcaaggacaaaagatactctgaagataagttccagtttcatctgcctatcagcctgaatttcaaatccaaggagcgcctcaactttaatctgaaagtgaacgagttccttaagcggaacaaggacattaatatcatcggcattgatagaggggaacggaacctgctctatctggtcatgatcaatcagaaaggagaaattctgaagcagacacttctcgactctatgcaaagcggcaaagggcgcccggagatcaactacaaggagaaactgcaggaaaaggagattgaaagagacaaggcgcggaaatcctggggaacggtggagaatatcaaggagctgaaagaaggctatctctctatcgtcattcaccagatcagcaagctgatggtggagaacaatgccattgttgtgcttgaagatctgaacatcgggtttaaaagaggccgccagaaggtcgagcggcaagtgtaccagaaattcgaaaagatgctcattgacaagctgaattttctggttttcaaagagaacaagcccaccgagcctggaggcgtgcttaaggcttatcagctgacagatgaatttcagtccttcgagaagctcagcaaacaaaccgggttcctgttttacgtcccctcttggaatacatccaagatcgaccctagaaccggattcatcgattttctccaccccgcctacgaaaacattgagaaggccaaacagtggatcaataagttcgacagcattcgctttaactctaaaatggattggttcgaatttacggctgacacaagaaagttctccgagaatctgatgcttggcaaaaaccgggtgtgggtgatctgcaccaccaacgttgagcgctattttacaagcaagaccgccaattcttccattcagtacaacagcatccaaattacagaaaagctgaaagaactcttcgtcgatatcccgttttccaatgggcaggacctgaagcctgaaatcctgcggaaaaacgatgcggtgttctttaagagccttctgttctatattaaaacgaccctctctctgagacagaataacggaaagaagggcgaggaagagaaagacttcatcctcagccccgtggtcgactccaaggggcgctttttcaattctctggaggctagcgatgacgaacctaaagatgccgacgccaacggcgcttaccacattgcccttaagggactgatgaatctcctggtgctgaacgagacaaaagaagagaatctttccagacccaagtggaaaatcaagaacaaggattggctggagtttgtttgggaacggaatcgctga

SEQ ID NO: 4626 - RNA, 2820 nt, synthetic construct
  misc_feature 1..2820: note = Cpf1 variant
  source 1..2820: mol_type = other RNA
atgaacctgtacagcaatctcaccaacaagtattccctgtctaaaacacttagattcgagctgatcccccagggcgaaacgctcgagaatattaaggcccgggggctgatccttgacgatgaaaaacgcgctaaggactacaaaaaggccaagcaaattatcgataaatatcaccagtttttcattgaggaaatcctgagctccgtgtgcatctctgaggacctcctgcagaactacagcgatgtctattttaagctgaaaaagtccgacgatgacaatctccagaaagatttcaagtctgcgaaggacaccattaaaaagcatatcagcagatacattaacgattccgagaaatttaagaatctgttcaaccaaaatcttatcgacgctaaaaagggacaggaaagcgatctgattctctggctgaaacagtctaaggacaacggcatcgagctttttaaggccaattccgacattacagatatcgacgaagccctggagatcattaagagcttcaaggggtggaccacatattttaaaggattccacgagaaccggaagaatgtttactcttccgatgacatccctaccagcattatctaccgcattgtggatgacaacctcccgaaatttatcgaaaataaggctaagtatgagaacctgaaagataaggcccccgaagctatcaactacgagcagattaaaaaggacctggccgaggagctcacattcgatatcgactataaaacctctgaggtgaatcaaagagtcttttccctggatgaagtgttcgagattgcgaacttcaataactaccttaatcagagcggcatcacgaagtttaacaccattatcgggggaaagttcgttaatggcgaaaacacaaaacggaagggcatcaatgagtatattaacctgtactcccagcagatcaatgacaaaaccctcaagaaatataagatgtctgtgctgtttaagcaaattcttagcgacacagaatccaagagcttcgtcatcgataaactggaggacgattctgacgtggttaccacgatgcagtccttttacgagcagattgccgctttcaaaacactcgaagaaaagagcatcaaagaaaccctgtctctgctctttgatgacctgaaggcccaaaaacttgatctgagcaagatttacttcaagaacgacaaatccctcacagatctgtctcagcaggtctttgacgattatagcgtgatcgggaccgctgtgcttgagtacatcacccagcaagtggcccctaagaatctggacaacccctccaaaaaggaacaggatctcattgcgaaaaagacagagaaggccaaatatctgagcctggagacgatcaagctcgctctggaagagttcaataaataccgcgacattgacaagcagtgtagatttgaagagatcttcgcctcttttgctgatattcctgtccttttcgacgagatcgcccagaacaaaaacaatctggcccaaatctccattaagtatcagaaccagggaaagaaagatctcctgcagaccagcgctgaagttgacgtgaaggcgatcaaagatctgcttgaccaaacaaataacctcctgcataagctgaaaattttccacatcacccagtctgaggataaggccaatattctcgacaaggatgaacatttttacctggtgttcgacgagtgctattttgaacttgctaacatcgtcgccctgtacaataaaatccggaactacattacacagaagccctattccgatgagaaattcaagctcaattttgagaacagcaccctggccaatggctgggacaaaaacaaggaacctgataatacggctatcctgttcattaaagacgacaagtactatcttggggtgatgaacaagaaaaataacaagatctttgatgacaaagccattaaggagaacaaaggagaaggctacaagaaggttgtgtataaactcctgccgggggcgaataagatgctgcccaaagtcttcttttccgctaagtctatcaacttctacaatcctagcgaggatatcctccgcattagaaaccactccacacacaccaaaaatggatctccccagaagggctatgaaaagctggagtttaacatcgaggactgtcggaaattcattgatttttacaagcatagcatctcccgccaccctgaatggaaagacttcggcttcagatttagcgataccaagaaatacaattctattgacgagttctatcgggaagtggagaaccaagggtacaaacttacatttgaaaatatctccgagagctatattgattctctggttgacgagggaaagctctacctgttccagatctataacaaagatttttccgtgtacagcaagggcaaacccaatctgcataccctttattggaaggccctcttcgacgaacgcaacctgcaggacgtcgtgtacaaactgaatggggaggccgaactcttttacagaaagcaatctatcccgaagaaaattacacaccctgctaaggaggccatcgctaacaaaaataaggataaccccaaaaaggagagcattttcgaatatgacctgatcaaagataagcggtttacggaggacaagttctttttccactgccctattaccatcaacttcaaatccagcggagccaataagtttaacgatgaaatcaatcttctgctcaaagagaaggcgaacgacgtccatattctgtctatcgatagaggcgaacgccacctggcctactatacacttgtggacgggaaaggaaatattatctgtaagaactga

SEQ ID NO: 4627 - RNA, 3795 nt, synthetic construct
  misc_feature 1..3795: note = Cpf1 variant
  source 1..3795: mol_type = other RNA
atgctgttccaggagtttacccacctctaccccctgagcaagacagtgagattcgaacttaaacctatcggcaagacgctggagcatattcacgccaaagactttctctcccaagatgaaaccatggctgacatgtatcagaaggtcaaagccatcctggatgactaccatcgggatttcattgcggacatgatgtctggggttgtgcttacaaagctggctgagttttatgaagtgtacctcgccctgcgcaagaccccgaaagatgacagcctgcagaagcagctcacagagatccaaaccgccctgagaaaagagattgtcaagcccatcggatccggcgggaaatataaggctggatacgatcggcttttcggcgccaagctgtttaaagacgggaaggaactcggagatctggctaaattcgtgatcacacaggagggcgaatctagccctaaacttgcccacattgcgcattttgagaaattctccacctattttacgggcttccacgacaaccgcaagaatatgtactctgatgaggacaaacacaccgccatcgcttacagactgattcatgaaaacctcccccggtttatcgacaatctgcagattctggccacaatcaagcagaagcacagcgctctctatgatcaaattgttaacgagctgaatgccaacgggcttgacgtgtccctggcgagccatctcgatggataccacaaactgcttacccaggaaggcatcacagcctataataccctgctcgggggaatctctggcgaggctgggtcccgcaagattcagggaatcaacgaactgattaatatccaccataaccagcactgccagaaaagcgagagaattgccaagctgcggcctctccataaacaaatcctgtctgacggcatgggcgtctccttccttcccagcaagttcgctgatgactctgaggtgtgtcaggccgttaatgaattttaccgccactatgcccatgtgttcgctaaggtccaatccctgtttgatagattcgacgattaccggaaagacgggatctatgtggagcacaagaacctcaatgaactgagcaaacaggcgtttggagatttcgcccttctgggccgcgtgctcgacgggtactacgtcgacgttgtgaaccctgagtttaatgaaagattcgctaaggccaaaacggataacgccaaggagaagctgacaaaagagaaggacaaatttattaagggagtgcactccctggcttctctcgaacaggccatcgagcattatattgcgggccacgatgacgaaagcgtccaggctgggaaactgggacaatacttcaagcatggccttgccggcgtggataacccgatccagaagattcacaattcccacagcaccatcaaagggtttctggagcgggaacgccccgccggagagagagctctccctaagatcaaatctgacaagtcccccgagatgacacagctgcggcagctgaaagaacttctcgataacgccctgaatgttgtgcatttcgctaagctgctcaccaccaaaacaacgctggacaaccaagatggcaatttttatggggagttcggagccctttacgacgaactggcgaagattgccaccctctataacaaggtcagagattacctgagccagaaacctttctctacagagaagtataaactgaattttggcaaccccacccttctcaatgggtgggacctgaacaaggagaaagataatttcggcgtgatcctgcagaaggacggatgctactacctcgctctgcttgacaaggcccacaaaaaggtttttgataacgctccgaatgccggcaaaagcgtgtatcagaagatggtctacaaactgctccctgggcccaacaagatgctgcctaaggtgttctttgcgaaatccaatctggactattacaacccctctgccgaacttctcgataagtatgctcaaggaacacataaaaagggcaacaatttcaacctgaaagactgtcacgccctgattgatttcttcaaggctagcatcaataagcatcccgagtggcagcactttgggttcgaattttcccctaccagctcttaccaggacctctccgatttctatcgcgaggtcgaaccgcagggataccaagtgaaatttgttgacattaacgccgagtacatcgatgagctggtggaacagggccagctttatctgttccaaatttacaataaggacttcagccccaaagcccacgggaagcctaacctccatacgctgtattttaaagctctgttctctgagaataaccttgcgaatcccatctacaagctcaacggcgaagccgagatcttttatcggaaggcttccctggatatgaatgaaacaaccattcacagagccggagaggtcctggagaacaagaatcctgacaaccccaagaaacgccagttcgtgtacgatatcattaaggacaaacggtatacccaggacaagtttatgctccatgttccgatcacaatgaatttcggcgtgcaggggatgaccattaaagaatttaacaagaaggtcaaccaaagcatccagcagtacaatgatgtgaacgtgatcggaattgacagaggcgagcgccatctgctttacctgacagttatcaattccaaaggggaaattctcgagcagcggtctctgaacgatatcattacgaccagcgccaatggaacacaaatgaccacaccttatcacaagatcctggacaaaagagaaatcgagcgccttaacgctcgggtcggctggggcgagattgaaaccatcaaggagctgaaatccgggtacctctctcacgtggtgcaccagattagccagctgatgctcaagtataatgccatcgtcgtgctggaagatcttaacttcggatttaagagaggccgcttcaaagttgagaagcagatttaccaaaattttgagaacgcgctgatcaaaaagctcaatcatctggctctgaaagacaaggccgatgacgaaatcgggtcctataagaacgcccttcagctgacgaataacttcaccgatctcaaaagcattggaaagcagacaggcttcctgttttacgtgcccgcttggaatacctctaaaatcgaccctgccacagggttcgtcgatctcctgaagccccggtatgagaacattgcgcaatcccaggcctttttcggaaaatttgacaagatcttctacaacgctgacaagggctactttgaattttatgtggattacgccaaatttaccgacaaggctaaaaatagcagacagacgtgggttatttgctctcacggggataagcggtatgtgtacgacaaaacagccaaccagaataagggcgctaccatcggaattaacgtcaatgatgagcttaaatccctgttcgcccgctatcatatcaacgacaagcaacctaatctcgtgatggatatctgtcagaacaatgacaaggaatttcacaaaagcctgatgtacctgcttaaggcgctgctcgccctgagatattctaacgctagctccgatgaggacttcattctcagccccgttgccgatgacaaaggcgtgtttttcaattctgctctggccgatgacacacagccgcagaacgccgacgctaatggggcgtaccacatcgcccttaagggactgtggctgctcaacgagctgaaaaattccaacgatcttgacaagattaagctggctatcgataatcaaacctggctcaacttcgcccagaaccggtga

SEQ ID NO: 4628 - RNA, 3903 nt, synthetic construct; identical to SEQ ID NO: 4623
  misc_feature 1..3903: note = Cpf1 variant
  source 1..3903: mol_type = other RNA

SEQ ID NO: 4629 - RNA, 3756 nt, synthetic construct
  misc_feature 1..3756: note = Cpf1 variant
  source 1..3756: mol_type = other RNA
atgaaccacatgaagcagttcaccaatcaatttagcctgtccaaaacactcagattcgagctgatcccccagggcaagacgaaagaatttattgagatcaacgggcttattgaaaaggacaatgagcgggccgtgtcttacaaaaaggtcaagaaaatcattgatgaatatcataagtacttcatcgagatggttctgtgcgactttaaactccacggactggagacctatgaaacaatcttcaacaagaaagagaaggatgacaccgataagaaagaatttgacaatattcgcaacagccttagaaagcagatcgctgatgccttcgcgaaaaatcctaacgacgagattaaggagcggtttaaaaatctgttcgctaaggaactcatcaaacaggatctgctgaactttgtggacgatgagcaaaaggaactcgtgaatgagttcaaggactttacaacctacttcacaggcttccatcagaaccgcagaaatatgtatgtcgccgatgaaaaagccaccgctattgcctaccggctggtgaacgagaatcttccgaagtttatcgacaacctgaaaatttatgagaagatcaaaaaggacgctcccgaactcatctccgatctgaacaagacgcttgttgagatggaagagattgtgcaggggaaaaccctggacgaaatcttctctctcagctttttcaatcagacactgacccaaacaggaattgagctgtacaacatcgtcattggcgggcgcaccgccgatgagggaaagacgaaaatcaagggcctcaatgaatacatcaacacagactataatcagaaacagaccgataagaagaaaaagcaggcgaaatttaagcaactgtacaaacagattctttccgacagacactctgtgagcttcgttgccgagacatttgaaaccgatgctcagctgctcgagaacatcgaacaattctattccagcgtgctgtgtaattacgaggacgatggccataccacaaacatttttgaggccatcaagaatcttattatcgggctgaagacgttcgacctctctaaaatctatctgcggaacgatacctccctgacagacattagccagaagctctttggagactggtctatcatttccagcgctctgaatgattactatgaaaaacagaaccctatctcttccaaggagaaacaggaaaagtacgacgagcgcaaagccaagtggcttaagcaagatttcaatattgagaccatccagacagcgctgaacgaatgcgacagcgagattatcaaagaaaagaataacaaaaacatcgtctccgagtactttgccaagctcggcctggataaagacaataagattgatcttctgcagaagatccaccacaactatgtggtgattaaagacctcctgaatgaaccctaccctgagaacatcaagctggggaatcagaaagagcaagtctctcagattaaggatttcctcgacagcatcctgaaccttatccatttcctgaaacccctctccctgaaggataaggacaaagaaaaggatgagctgttttatagccttttcaccgctctctttgaacacctgtctcagacgatttccatctacaataaagttagaaactatctgacacagaaggcctacagcaccgagaaaattaagctcaatttcgaaaactctaccctgcttaatggatgggacgtgaacaaggagcctgtgaatacaagcgtcatctttcggaaaaacggcctgttctatctcgggattatgtccaagtctaataaccgcatctttgagagaaacgtgccggtttgtaaaaatgaagagaccgctttcgaaaagatgaactacaaactgctgcccggagccaataagatgcttcctaaagtgtttctcagcgccaagggcatcgagtccttccaacccagcgctgaaattcagtctaagtaccagaaagagacacataagaaaggcgacgcgtttgtccggaaggatatggagaacctgatcgacttctttaaacagtccattgccaagcacacggattggaagcacttcaatcatcaattcagcaaaaccgaaacatataacgacctgtctgagttttacaaggaagtggagaaacaggggtataagctcaccttcacaaaactggatgagacctacatcaatcagcttgttgacgaaggaaagctgtatctctttcaaatttacaacaaggatttctccccttttagcaaaggcaagcccaatatgcacacgctgtattggaaaatgctgttcgacgagcagaaccttcagaatgtggtctacaagctcaacggggaagctgaggtgtttttccgccagtcctctatcaaacaaaccgatagaatcattcataaggccaatcaggccatcgacaacaagaatccgctgaacaacaaaaagcagagctcctttaattacgatctgattaaagacaagcggttcacactcgataaatttcagttccacgtccctatcaccctgaacttcaaggctgaaggaaatgagtatcttaacacaaaggtgaatgagtacctgaaatctaacagcgacgttaagattatcggcctcgacagaggggaacgccatctgatttatctgacccttatcaatcaaaaaggagagctcctgaagcagcagtccctgaacgtgatcgccacgagccaggaacacgagacagattacaaaaatctcctggtcaacaaggaaaatgagcgggcgaacgctagacaagactggaaaaccattgagacaatcaaggaacttaaggagggctatctgtctcaggtggttcaccagattgccaccatgatggtggatgaaaatgccatcgtcgtgatggaggacctcaacgctggctttatgcgcgggcggcaaaaagtggaaagacaggtttaccagaagctggagaaaatgctgattgagaaacttaattatctggtcttcaagaacaatgatgtgaacgaaaccgccggagtgctcaacgctctgcagctcacaaataagtttgagtccttcgaaaagatgggcaaacaaagcgggtttctgttctacgtccccgcctggaacacgtctaagatcgaccctgcgaccggatttgtggatttccttaaacccaagtacgagtccgttgagaaagccaagctgtttttcgaaaagtttgagagcatcaaattcaatgctgacaagaactattttgaatttgagttcgattacaaaaagttcacagaaaaagccgagggctctcagaccaagtggacagtgtgcacccatagcgacgtccgctatcggtacaatccccagacgaaggcttccgatgaggtgaacgttacaaatgaactcaaactgattttcgacaagtttaaaatcgagtataagaacgggaaaaatctgaagaccgaacttctgctccaggacgataaacaactgttcagcaagctcctgcactaccttgccctgaccctcatgctgagacagtctaagtccggcacagacattgattttatcctgagccctgtggcgaaaaacggagtcttctatgactcccgcaatgccatgccgaaccttcccaaggatgctgacgccaatggcgcttttcatattgccctgaaagggctctggtgtgtgcagcagatcaagaaagccgatgacctgaagaagatcaaactcgctatttctaacaaggagtggctgagcttcgttcaaaatcttaaatga

SEQ ID NO: 4630 - RNA, 4173 nt, synthetic construct
  misc_feature 1..4173: note = Cpf1 variant
  source 1..4173: mol_type = other RNA
atgatcgacaacaccaaggagaaaaaggaaggcagcgtgttcgatgggtttacaagaaaataccagctgtccaagacgctccggttcgagctgcgccccattcttaatacccctaaaatgctggacgatgaacaagtcatcaagaacgacgagacaagacggaagaaatatgaagccgttaagccgtggtttgatcagctccaccgcgagttcattgaggacgctctgaaatcttttaagttcaaaaatcttgccatctaccaggatacctttcagacatggcaaaaggacagaaagagcaaacagaagaaagataccctggtgaagattgaagtgggactccgggaggaaatcgtccgcagattcgaggaggtggcgaacatctgggttcggtccgaacagtataaactgctgggcattaagaaagaggggctcggaatgctgtttgaagctggcgtgttccgccttctgaaggagagatttaagaatgaaaaagacacaaccgtcgatgggaacaatatcttcgacgagtggacgcggtggaccggatactttaagaaattcttcgagacacgcaagaacttttataaatctgatgacaccagcacagccattgcctacagagtgatcaatcagaacctccggcgcttctgcgaaaatattcaaatctttgagaagatttccgaaaagatcgagttctctgaagttgagaaatcttttgacatctcctgtgctggcattttcagcctggcctattacaacgcttgccttctgcagggcgggatcgatacctacaataagattatcggaggcgaggtggacgaaaaagataagaaaattcccgggatcaacgagctcatcaataagtatagacaggacaactctggagaaaagattccttttctgaaacagctggataagcaaatccattccgccaaagaggcgttcattgaaagcatcgagacgaacaaggagctcgtcggcaaactgaagacattttacgaaaatgccgaggtgaagattcagtctttccggaaccttatcgctgacatcgtgaccgattattccgggtacgacattgataaaatctatctgacaaaggaagccgtcagccacaatgcttctagatggtttgcctccttcgagagctttgagcgcgacctcttcgcggttgtggccgaaaaacagaacaagctggtgtacgagcttctgcggacccataaaaatgattccaagatttctgacaaagacggaaagttcagctttcccgatttcatcaagtgttcccacattaaaagagctctcgaaaagcaagagggccgcatctggaaaggcgaatattacgaggacattgtcgattttgagaagatcaaagacgtgttcacccagtttctgtgcgttttcaagtttgaactggagcagcagttctttcggaagacaacgagcgcccaaaccggggaacagacaaaaatcggatacgagattttcgtgaccaagatcaacgaactcattacaagagagaatcctgtcatcgatctggaggagaaaattgctatcaagaactttgccgacgccacccttctgatctatcagattgctaaatacttcgcggtggaaaagcgccggggctggctcgataattatgacctggatgacagattttacaagtcttccgatatcgggtatcttaacttctaccgcgacgccttcgaacagattgttcggccctataatctgtttagaaactacctcacgaaaaagccttacaatacaaacaaatgggtgctgagcttcgagaatccgaccctggctgatggatgggacaagaacaaagaaaagaccaacgccgccgtcatcctccgcaaggacggccggtattacctggggattatcaaagaggattgtaagtctctttttgctgacagatatagcaaagagatgtccgaaggaatcgagtctggcagcttccaaaagatggcctacaaatttttccccgaagcgtccaagatgattcctaaatgcagcacacagaccaagaatgtgaaggagcattttcggaaatcttccagcgattataacctgttccacgagaaggactacaaaatctctgtcgctattacaaagaatatctatgaactcaacaatgtgttttaccgcaaagataacattgaggaatccttcgttcccaagaatgactttgagaagaaactgggcgtgaagaaattccagagacagtacctggaaatcagccgggataacaatgggtataagcaagcccttgcccagtggatcgagttctgtattagatttctcaaggcttacaaatccacgaccatcttcgactattctcgcctgcgggaggccaaggaatacgagagcctggatgctttttatcaggacattaacgccctcacatacaatatctccttcgtccctatttctgaacagtatatcaaagagaagaacgataatggagaactgtttcttttcgagatttacaacaaagactggagcctgggccccatggataagaatagaaaacgcaccaagaacctccacacactgtactttgagcaactgttctccaaggaaaacgagcaggaaaattttcttttccagctcaacggggaggcggaactgtttttcagaccgaaaaccgaggagaagcggctgggatataaagtgtgggacgccggcgaaaagaaatgggttaaggctaaggagaaagaagacggggccgtgatcgatcgcaagagatacgctaaagacatcattctctttcattgccctatcacgctgaatcgggtcagcgagtctaagaccaaacgcgagatggatgtggaaattagagaggtgctttccagcacacccggcgttcacatcattggagtcgaccggggcgaaaagcatctggcctattactctgtgatcgatcaaaacgggaaaatcattgagaccgacacactcaattccatcggaaaggatggccgcgggaagcctgtggaatatgcgagcaaactggagaagagagcccaggagcgggaagctagccgcagagactgggaggaagtcgaggccattaaagatctgaagaaaggatacatcagccaggtgattcggaaccttgctgacctcatcatcaagcacaatgccattatcgttttcgaagatctgaacatgagattcaagcagattcgcggcgggatcgagaaatccgcctatcaacagctggagcgggctctcattgacaagctgagctttcttgtgaaaaagggcgaagaggaccccaaacagaccggacacatcctgagagcgtaccagctcgccgctcccgtcattgccttcaaggatatgggcaagcaaacggggctgatcttttacacacaggccggatatacctctaaaacatgtcctgaatgcggctaccgccggaatatcaagtgtctgttcgagaacattgaacaggctaaaacccttatcgagaatctcgagtccattaactataataagaaagaagacgtgtttcagatcagctactccctggagaagctgtctagcaaggatcagaaaaaggagaaaaaggtttccaacgaactctatgccaaaaccctgaagaaagacattttcatccttacaacgaagaatgcgctgagatacaagtggtatgatcgctactctgagaaagctaaggtggccaaacgggggatcgacgaatacaagggagaggtcaacgaaagcgagaccaaaaagggcgtggttaaggaatttaacctcacagagtatctgaaagggctgcttaagacctacgagattgattatgaacatggcggaatcagagagcaaattctgtccgtggcccgcggccgggagttctacaaagactttctctatgctctgttcctcctgacagaaaccagacactctatcagcgggcggaatacggattacattcagtgcccggaatgcgagtttgactcccgcaagggattcaaagatatcaaggagtttaacggcgacgccaatggggcgtataacatcgctagaaagggaattatgatccttgaaaagattaaacaattcaaaaaggataatgacggcaacctggagaaaatggggtggggcgacctcagcatctctattgaagagtgggataagttcacacagaaggaatga

SEQ ID NO: 4631 - RNA, 4026 nt, synthetic construct
  misc_feature 1..4026: note = Cpf1 variant
  source 1..4026: mol_type = other RNA
atgaacgccgagaagaaatgcgctttcaatgaatttaccaacctgtacgagctcagcaagacactgaaattcgaacttaagcccgtgggcaaaacgaaggagatcattaagaattttagagaggaactggagaaaaacaatcctatccagctcgacaaggaaatttccatcgccaaacaagagattaagaaagatctggacatccttcaccgggaatttgtccgccagtcttttgagctggcgttcaaggagaacaagatcaattatgaaattttcttcgagatctacagaaactttaaaaagttcagcaaaaataagaaatccgatgaatatattgctgccatcaagaacctcaaagaggaaaagattaagctggttaaaaagatcgccgactactttgtgaaaatggatcaggagtggcggaagtattacccgtctgagaaaaagagcttcctgctcatgtccaatggggtgattaacctgcttatcgacatcaataaggatcgcatggactattcttttattcccaaagaagtctgtgagaagatcaaaggaaagggcaaaattgaactgtacgagaagttcaacaagcatttcgggtacctcagcaaatataataccgctagagaaaacttttactccgatgacgtgaagaacagcgcctctgttgcttatcgggccatctgcgagaatctggagaaattctgtgataacaagattaaagtggaagcggacaattttcctaaggagatcaaggaaaaattccttgagtactttaacaagatcacagatctgtccttctataatcgctgcctcagccagaacggaattgaagagtaccacaaatttaaggacgagatcaatagatctattaacgaactgtatcccaataactccaaaaataagcctcaaaacatcccctacctgagcaaactcgacaagcagattctgtctgagaaggataaacagtcctggatcgaagagggcttcatcgacgagaataactttattttcgaatttgagaagttcatcaaaatgaatgataagtacattcctagcgaaaagaaactttttaacgagttcttcatctttcagaacaatgacgaagtcctgcaaaaactcttcctgcttaaaaagaccattaacaattttgccaacatctatctggatgacccgaaaaatctcatggatctgatgccctccaaggggacaaagaagcgggactacctgtctctcctggagattaaggaggctcttaacagctatgccgaaaatcagaacatcggagagacccagatcttcaaaattaagtacgatgacgtgatcgataaaacaaagaccccttttgaatgtttcatgaaaatttggaagtatgagtacgacctgctctataatgaaggcgacggcaagaaaaacatcgaggaggggtgggaaaagatttgcgagaaactgcagaataagaaagatgaatttacgggagactacggcaagtacaaaaaggagatcaaggattattgtgaaatggctctttccctgagccaacgcatcaaacatctcgacattagaatcaagaaacgggatgggtctgaggacgccgataacaatctgttcgagggagttgaaaagctggacgagttttacgatcgcctcttcgaaattgtggacgagcacaacgcgtatcagtaccatcacgagtttcaggccttcctgaccaaaaagccctataagacagataaatttaaactttccttcgacaatcctcaactgctcaagggctgggatctgaacaaggaacccgactacttcggggctctgcttgtcaaaaacgagaagtattttctcgccgtgttccacaagcagtacgctaatgaaatctttagacagaaaaacaagaatagcaccgtgaaaattaaggaggcctacgacgtcttcaacggaaattattacaaaaaggttgaactgaagcagatcccgaaactgtttatgaacctccctcggatctgcttcgccaagtctaatcaagaggagtttggcctgacaattgaacttgagaaaatcaagagcgagttcgataaatttcagaagctgaagaaagaacgccaggacaacaatctcaagttcgatcaggaaaaatttattaagctgctggcttattacagacattgtcttgagatccgggaggactggaaagtgttcaagtataacttcaaacccctctacaagtattccaatctgggcgaattttacagagatctggagaaggacacctacaacctcgatctggtgcgcgtcaattctgaatatgtggagaaaaagcggaacgaagggaaactttacctgttcgaggtttataataaggactttagcgataaatccattggaagaaagaacatccacagcgactacttcaagtctctctttctgcctgataacctgacgaataaaaagatcgcgcttgccgctgacgccgagattttctttcgcgaaaaatccctcaagaacaaagatgagatcattacacaaaagaataagatcaaaattgacaagaacaatcataaaggcgaaaaggcctatagcaaaaaccggtacaccgacgataagatcattctgcatctgcccatcaatctcaacttcggggagaataagaaccacaaagactttaattatgagatcaacgattctctgcttaagaataacagagacattaaaatcattggaatcgatcgcggcgaaaagtacctgctctactattccgtgattgaccagaaaggggatatcaaggagatgggagacttcaatgtcgtgaacggcgttgattactatagcaaactggtggcttacgaagagaagcggaagcaggccagactggactggggcgatatccagtccattaaagaacttaaggaggggtatatctctcacgtcattcacgagatctgcgacctcattaaaaagtacaatgcgatcgtggtcctggaagacctgagcatgggatttaaacgcggccggttctttagagagcgccaagtgtatcagaagttcgaactcgctctgttccggaaacttaactactgggttgataagaacaaggaggaaggggagaaaggatccgccctgtctgcctggcagctcacacccaatgagaaggactttaaagtgagccagctggaaaaggctagacaactgggcatccttttctacaccgccgctgggtatacctccaagacatgtcctgattgcggctttcggaaaaacattacgctgaagtacgtcaatgacaaacagctcaaggaggatctgggaaaactcaagatcaacttcgtggaagaccattttaagattaaatataatctgcttgatttcgagaagaacaaaaagagcgaaaaagccaaggacaccgttctgccgaaagaggagcgcaagatctcttttgtggccaattccaaggtcattagaatccggtggcacgatattaaaacaaagctcgcgaaaagagaactggacggcgagaagatcatcaaaaagttccccaagggggtgattaaagaatacgatatcaacatttgcctgaagcgcatcattggagacaaaatcgattttagcaaggactctatcaccgagcagcttattaatggccggttcgggaaagacttttattgggagctgatgtacttcctcaacctgatcctcgaaattagaaatgtggtttccgagacagaaatcgattatattcaatgtcctgtctgcggatttcatagcgacgatggcttccgcgggaacaagttcaatggcgacgctaacggagcctacaatatcgctagaaagggccggctgatccttgagaaaattaaccagcacaagaacctgaaagaactcaagaccggggatctgtctgtgaatatcgtggagtgggacaaagccgtcaacaattgggataagtttgtgcagggagacaacacggagagcaagaatattgaaatccccgcgaaagaggaaatgatttccgttgaggtgcgcgaaagctga

SEQ ID NO: 4632 - RNA, 4107 nt, synthetic construct
  misc_feature 1..4107: note = Cpf1 variant
  source 1..4107: mol_type = other RNA
atgaagaaagagaaggagttcaaatcttttggcgacttcaccaacctgtacgaaatctccaagacactcagatttgaactgaaacccgtggagaatacgcagaccatgcttgatgaagccgacgtcttcgggaaggataaggttattaaagacaagtatacaaaaaccaagccttttatcgataaactgcaccgggagttcgtggacgagtctctcaaggatgtgagcctgtccggacttaagaaatactctgaagtcctggagaactggaagaaaaataagaaagacaaggatattgtgaaagaactcaagaaggaggaggaacgcctgagaaaagaggttgtggaatttttcgacaacacagctaagaaatgggccaatgagaagtataaagaactgggcctcaagaagaaagatatcgggattctgtttgaggagagcgtcttcgaccttctgaaggaaaaatacggagaggaacaagattcctttctcaaggaggaaaaaggcgacttcctgaagaacgagaagggggagaaagtgtctatctttgacgaatggaagggattcgttggctatttcaccaaatttcaggagacacggaagaatttctacaaaaacgatggcaccgaaacggcgcttgctacccgcatcattgaccagaatctgaagagattttgcgataacatcgacgatttcaagaaaattaagaataaaatcgactttagcgaggtggaaaagaacttcaataaaacagccgatgtcttttccctcgacttctataaccagtgtctgctgcaaaaggggattgatagctacaatgagtttatcggaggcaaaaccctcgagaacgggaagaagctgaaaggagtgaacgaacttgtgaatgagtaccggcagaagaacaaaaatgaaaaggtctctttcctgaaactcctggacaagcagattctttccgagaaggagaaactgagctttggcatcgaaaacgatgagcagctcctggttgtgctgaatagcttctatgaaacagccgaggaaaagaccaaaatcctccgcacgctgtttggggacttcgtggagcataacgagaattacgaccttgataagacatatatttccaaagtcgctttcaacaccatcagccacaagtggacaaatgaaacccataagtttgaggaactgctctacggagccatgaaagaggacaagccgattggcctgaactatgataaaaaggaagactcttacaaattccccgattttatcgctcttggctatctgaagaagtgcctcaataacctggactgtgataccaaattctggaaggagaaatactacgagaataacgccgacaagaaagataaggacaaagggtttctgacaggaggccaaaatgcgtgggatcagttcctccagatttttatcttcgaatttaaccagctgttcaactccgaggcctttgacaataaggggaaggaaatcaaaattggatatgataacttcagaaaggactttgaggaaatcattaatcaaaaagacttcaagaacgatgagaatcttaaaatcgctattaagaacttcgccgacagcgtgctgtggatctaccagatggctaagtattttgccatcgagaaaaagcggggctgggatgacgatttcgaactctccgagttttacacgaatccttctaacgggtatagcctgttctacgaccgcgcgtatgaagagattgttcagaaatacaatgatctgagaaactaccttaccaagaaaccctataaggaggacaagtggaaactcaattttgaaaaccctacactggccaatggattcgataagaacaaagagtccgacaatagcaccgtgatcctgcggaagaaacgcaagtactatctcggcctgatgaagaaaggcaacaacaagatttttgaagatagaaataaagctgagttcatccggaacattgaatctggggcctacgagaagatggcttataaataccttcccgacgtcgccaagatgatccctaagtgctccacacaactgaatgaggccaaaaaccactttcgcaatagcgctgatgacctcgaaattaagaaatctttcagcaacccgctgaagatcaccaaaagaatctttgacctgaataacattcagtatgataagacgaatgtgtccaaaaagatctctggagacaacaagggcattaaaatcttccagaaggagtactacaaaattagcggggatttcgacgtttataagtccgcgcttaatgattggatcgacttttgtaaagatttcctcagcaagtacgactctacaaaggattttgacttctccatcctgcggaaaaccaaggattataaaagcctggacgaattttacgtggacgtcgccaagattacctataaaatctctttcacacccgtgtccgagagctacattgatcagaagaacaagaatggagaactctatctgtttgagatctacaaccaagacttcgctaaaggcaagatgggggccaaaaatcttcataccctgtactttgagaacgtcttctcccctgaaaacatttctaagaattttcccatcaaactcaacggcaatgccgagctgttctttagacctaagagcatcgaatccaagaaagagaagcgcaacttcgtgcgggaaattgttaataaaaagagatattctgaggataaaatcttctttcactgccccattacactgaaccgcgagacgggaagcatctaccggttcaataactatgtgaataactttctttccgaaaataacattaatatcatcggcgtcgacagaggggagaagcacctcgcttactatagcgtgattgataaaaacggagttaagatcggcgggggatctttcaatgaaattaacaaggtggactacgccaaaaagctggaggagcgcgcgggcgaacgggagcagtccagaaaagattggcaggtcgtggaagggatcaaggacctgaaaaagggctatattagccaggtggttcgcgagctcgctgatctggccatcaagcataatgccattatcgtccttgaagacctgaacatgcggtttaaacaaatcagaggaggcattgagaagtctatctaccagcagctcgagaaagctctgattgataagctgtccttccttgtggaaaaaggggagaaggacccgaaccaggccggacacatcctcaaggcttaccaactggccgcgccttttaccagcttcaaagatatgggcaagcagacagggattgtgttttatacccaggcctcttacacaagcaaaacctgtcccaattgcggattccgcaagaacaataacaaattttatttcgaaaataacatcggcaaggctcaggacgccctgaagaaactcaagacgtttgagtacgactccgaaaataaatgtttcgggctgagctattgcctttctgatttcgctaacaaggaggaggtcgagaaaaataagaacaaaaagcggaataacgccccttactccgacatcgaaaagaaagattgttttgaactgagcaccaaggacgcggtgagatatcggtggcatgataaaaatacagagcgcggcaagaccttctttgaaggagagtccgtttacgaggaaaaagaggaaaaggagattggccaaacaaagagagggctcgtgaaagagtacgacatctctaagtgcctgattggactgttcgagaaaaccggccttgattataagcagaacctgctcgacaaaatcaatagcgggaagtttgatggaacgttctacaagaacctgtttaactatctcaatctgcttttcgaaattcggaactccatctctggcacagaaatcgactacattagctgccccgagtgtcagtttcacaccgataaatccaagacaatcaaaaatggggacgataacggctcttataatattgccagaaagggaatgatcattctggacaaaatcaagcaattcaagaaagaaaacggcagcctcgacaagatggggtggggagagctgtttattgatctggaggaatgggacaaattcgctcagaagaaaaataacaatatcatcgataagtga

SEQ ID NO: 4633 - RNA, 4149 nt, synthetic construct
  misc_feature 1..4149: note = Cpf1 variant
  source 1..4149: mol_type = other RNA
atgagcaagaacaatgtgtgggacaaattcaccaaccagtactccctgtctaagacactcagatttgagctgaaacccgtcggcaagacgcgggaaaagatgaatgagcaacttaagtatgataagcagctgcagaccttcctcaaagaccaggaaatcgaggatgcctaccaatatctgaagccgtttttcgacaaacttcacaaggaatttattacagatagcctggactccgataccaccaaaaagatcgacttctctgattacctcattgactatcgcgataagaaagacctgacaaagaaagaggatagcctgagaaagaacatcggggaggtttttgtgaaagctggagaccggtggaagaaagaaaagtaccctaagtatgagtggaaaaagggctccaatgtggccaacgggtctggcattctcctgacacaggacgtccttatgctgatcaaagatctcaatcccaacgaccagaagatcaaaaagatgattgaagagaccttcaagggatttttcacgtactttagcgggttcaatctgaaccgcgagaattactataccacaaaagtggaaaaggcgaccgctgttgccacaagaatcgtgcatgataaccttcctaaattttgcgacaatctggtccagttcgagtgtattatcaagaaaaagaagaacggagaagtggatcggattgagcgcaaatccgaatacctcaatgcctatcaatacctcaagagcaaaggcagaaccacgcagatcaaggacgctgagtctggcaaaatgattgaggccgaagttatcaacgagaacatgttctccatcagctatttttctgcttgcctgtcccagagcgggattgaagagtacaatcggacaatcggacactataacctgctgattaatctttacaaccaggccaaggaaggcgaggagaaggatctgaaaaagtctgagaaaaagttcaaacgcctccccatctttaagaccctgtacaaacaaattgggtgtggagaaaaggaacctcttttcttttccctgacacatgacaccaagctccaggtgcaggagaataaagaaaactataagaaaccctacagcgtcgagcaaatcctggagcaggcgaagctggccggcgataaatatttcaaggggaagtccaatgacggaatcctcaacaccattcctgaattttctgattacatcctgcagaaagagagctatggcggcgtgtactggtccaaggtggctattaatacaatcagcaacagatatttcgaaaattggcacacgcttaaagacgccctgattgacgctaaggtctttgagaaagggaagaagggagatgaggaagacgttaaaatcccggagtctatcgaactccagggcttctttgatgtgctggacacccaagaggggtggaagtccgaaggaattttctttaaaaagagccttacagaggagctgaaaaacaaggaagccgataccaagaataaaaagcggcgcgagatcgtgaaagaagcgaagagaccctctcaggccctcctggctctcctgttcgacgatattcaggagcatgccaacctgttccttaatcagagcgacgaaatcctgaaactcgagaagtactccgagaaagaatctaaggagaagattaaacaatggatggatagcgctctggccgtcaaccggatcctgaagtactttttcgtgaaagaatccaaggccaaaggcgagcagattgaccctatcatcagcgaagctcttaaggttctctttaactctgaggatgcgacatggttcaagtggtatgacgccctgcgcaattacctgaccaaaaagccccaggatgacgtgaaagagaacaagctcaaactgaattttgaaaactccacgcttgctgggggatgggacattaataaggagagcgataactattgcgtcatcctgcaggaccaaaagggcaaacagcacctcggcattatcgccaagaaagaaaagcagagagggtacaataaaattttcgagcggacacctgagaaccccctgtataagatcgattctggagaagtgtggcagaagatggagtacaaacaaatcgccgttccgaccggcattgggggatttgtgagaaagtgtttcaataccgctcagcagtatggctggaaatgccctgacaactgtcttaattccgaagggaagatcattatcaaaaacgatgaggccaaggaaaatctggaggcgattatcgactgctacaaggactttttcacaaaatacgagaaggatggctttaaatataagaacttcaattttaacttcaaagaaagcgaggaatacgaggaactcaactccttcttttctgatgtcgagcgccaaggatataagctgggcttcatcaccgtgaataaaacaattatcgacaagtgggtcgaggatgggacgatttacctgtttgaaatcaagaaccaggacaccaatgatggcaaaaaggacggacacaaaaacaatctccatacaatttattggaaggctctgttcgaggacgtggggaacaaacccaaacttaatggaggcgccgaactgttttaccggaaggccctcctgaaagataagcaggagaaaatcgaagacaactatgggaaggagatcattaaaaatttcagatttagcaaggagaagttcctgtttcactgtcctatcaaacttaactacaaggctaaatcctactctcatcccaagtatgccctccccgaaattaataaacagaccaacgagttctttatcacaattagcgatatctgcttcctgggcattgaccgcggagaaaagcacctggcttactattccctcgttaatcaaaaggaggagatcatcgatcagggcaccctgaacatgcctttcgtggacaaagatgggaagccgcggagcattaaaaaggaaaaatttagattcgacgccaaggtcgataaatgggtgtctgaggaaatggactgttggaattacaacgatcttctggacgcgatggcctccaaccgcgacatggctcggaagaattggcagacgatcggaaccattaaggagctcaaaaacggctatatcagccaggttgtgagaaagattgtcgatctggccatcgacaaaaatcgcgggatcccctcttttattgtgctggaaaaccttaatgctggattcatgcggggcagacaaaagatcgagaaatccgtgtaccagaagctcgagctggccctggcgaagaaactcaactttgttgtcgataagacagtgcagaatggggaaattggcagcgtgaccaacgccctgcagcttacacctcccgtcaccaatttccaaaacatcgagaatcgcaaacaggtgggaattatgctgtatacgcgggctgactacacatctcagaccgatcctgttacaggctggagaaagagcatctacctcaaaaaggggtccgaagagtatatcaagagccaaattatggactcttttgatgacttcggatttgatggcaaaaactactatttcaagtacaccgtggacctgatcgatcccattaaaaagacctccgagaaaaagtttaagaaacagtggacactgtatagcgggatcaatggaaagtcccttgaccggttccgcggcgaaagatctagcgataaaaacgtctggattaagacgctgcaggacatcaaaaccacactcgacgccgtgtttattgggttcgatctgcagcactccctccggtctcaaatcatcaatgacggcattatgccgaagaaaatcgagaacagccagttcaccggatgggaatccctgagatttgctattgagatgatccagcagattcgcaatatcggcgttgaaaagggggatgaggacttcatcctttctcctgtgcgggataagaacgaaaaccattttgacagcagaaaagccaaggagaatgagcccaactccggagatgccaatggcgcttacaacattgcgcgcaaagggatcattatgaatgaacacatcaagaaagacctgattcctttcatccaagataaggagtgggacgcctggctcgctggaagagaagtctgggataagtggctgatcgagaacaaagacagcctgatttataagaaatga

SEQ ID NO: 4634 - RNA, 4203 nt, synthetic construct
  misc_feature 1..4203: note = Cas9 variant mRNA product
  source 1..4203: mol_type = other RNA
atggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaatga

SEQ ID NO: 4635 - RNA, 4986 nt, synthetic construct
  misc_feature 1..4986: note = Cas9 variant mRNA product
  source 1..4986: mol_type = other RNA
atggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtga

SEQ ID NO: 4636 - RNA, 3258 nt, synthetic construct
  misc_feature 1..3258: note = Cas9 variant mRNA product
  source 1..3258: mol_type = other RNA
atggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaatga

SEQ ID NO: 4637 - RNA, 4326 nt, synthetic construct
  misc_feature 1..4326: note = Cas9 variant mRNA product
  source 1..4326: mol_type = other RNA
atggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaatga

SEQ ID NO: 4638 - RNA, 3402 nt, synthetic construct
  misc_feature 1..3402: note = Cas9 variant mRNA product
  source 1..3402: mol_type = other RNA
atggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaatga

SEQ ID NO: 4639 - RNA, 4263 nt, synthetic construct
  misc_feature 1..4263: note = Cas9 variant mRNA product
  source 1..4263: mol_type = other RNA
atggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaatga

SEQ ID NO: 4640 - RNA, 3345 nt, synthetic construct
  misc_feature 1..3345: note = Cas9 variant mRNA product
  source 1..3345: mol_type = other RNA
atggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtga

SEQ ID NO: 4641 - RNA, 4101 nt, synthetic construct
  misc_feature 1..4101: note = Cas9 variant mRNA product
  source 1..4101: mol_type = other RNA
atggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaatga

SEQ ID NO: 4642 - RNA, 4134 nt, synthetic construct
  misc_feature 1..4134: note = Cas9 variant mRNA product
  source 1..4134: mol_type = other RNA
atggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtga

SEQ ID NO: 4643 - RNA, 3267 nt, synthetic construct
  misc_feature 1..3267: note = Cas9 variant mRNA product
  source 1..3267: mol_type = other RNA
atggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaatga

SEQ ID NO: 4644 - RNA, 3345 nt, synthetic construct
  misc_feature 1..3345: note = Cas9 variant mRNA product
  source 1..3345: mol_type = other RNA
atggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtga

SEQ ID NO: 4645 - RNA, 3351 nt, synthetic construct
  misc_feature 1..3351: note = Cas9 variant mRNA product
  source 1..3351: mol_type = other RNA
atggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaatga

SEQ ID NO: 4646 - RNA, 3051 nt, synthetic construct
  misc_feature 1..3051: note = Cas9 variant mRNA product
  source 1..3051: mol_type = other RNA
atggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaatga

SEQ ID NO: 4647 - RNA, 3462 nt, synthetic construct
  misc_feature 1..3462: note = Cas9 variant mRNA product
  source 1..3462: mol_type = other RNA
atggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaatga

SEQ ID NO: 4648 - RNA, 4020 nt, synthetic construct
  misc_feature 1..4020: note = Cpf1 variant mRNA product
  source 1..4020: mol_type = other RNA
atggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtga

SEQ ID NO: 4649 - RNA, 3999 nt, synthetic construct
  misc_feature 1..3999: note = Cpf1 variant mRNA product
  source 1..3999: mol_type = other RNA
atggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaatga

SEQ ID NO: 4650 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4651 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4652 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4653 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4654 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4655 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4656 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4657 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4658 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4659 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4660 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4661 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4662 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4663 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4664 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4665 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4666 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4667 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4668 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4669 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4670 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4671 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4672 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4673 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4674 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4675 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4676 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4677 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4678 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4679 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4680 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4681 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 4682 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4683 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4684 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4685 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4686 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4687 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4688 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4689 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4690 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4691 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4692 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4693 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4694 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4695 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4696 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4697 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4698 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4699 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4700 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4701 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4702 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4703 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4704 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4705 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4706 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4707 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4708 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4709 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4710 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4711 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4712 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4713 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4714 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4715 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4716 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4717 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4718 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4719 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4720 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4721 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4722 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4723 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4724 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4725 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4726 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4727 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4728 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4729 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4730 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4731 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4732 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4733 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4734 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4735 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4736 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4737 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4738 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4739 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4740 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4741 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4742 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4743 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4744 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4745 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 4746 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4747 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4748 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4749 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4750 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4751 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4752 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4753 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4754 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4755 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4756 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4757 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4758 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4759 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4760 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4761 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 4762 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4763 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4764 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4765 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4766 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4767 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4768 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4769 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4770 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4771 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4772 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4773 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4774 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4775 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4776 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4777 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4778 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4779 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4780 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4781 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4782 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4783 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4784 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4785 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4786 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4787 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4788 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4789 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4790 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4791 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4792 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4793 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 4794 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4795 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4796 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4797 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4798 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4799 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4800 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4801 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4802 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4803 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4804 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4805 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4806 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4807 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4808 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4809 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4810 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4811 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4812 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4813 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4814 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4815 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4816 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4817 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4818 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4819 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4820 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4821 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4822 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4823 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4824 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4825 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 4826 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4827 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4828 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4829 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4830 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4831 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4832 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4833 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4834 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4835 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4836 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4837 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4838 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4839 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4840 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4841 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4842 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgacaagaaatacagcattggactggatatcggcaccaactccgttgggtgggcggtgattacagacgagtataaggtgccgtctaagaaattcaaggtcctcggaaatacggatcggcatagcatcaaaaagaacctgattggcgctctgctgtttgactccggggaaaccgccgaggccacacgcctcaaaagaaccgctcggcgcagatacacacggcgcaagaatagaatctgctatctgcaggaaatcttctctaacgagatggccaaggtggatgacagctttttccaccggcttgaagagtcctttctggttgaggaagataaaaagcatgagcgccaccccattttcggaaatatcgtggacgaagtcgcttaccatgagaaatatcctaccatttaccacctcagaaagaaactggtggattctacagacaaggccgatctgcggctcatctatctggcgcttgcccacatgattaaatttcgcggccatttcctgatcgagggcgacctcaaccccgataatagcgacgttgacaagctgtttattcaacttgtgcagacctacaaccagctgttcgaagagaatcctatcaacgcttccggggtcgatgccaaggctatcctcagcgccagactgtctaaatcccggcgcctggaaaatctcattgcgcagctgcccggagagaagaaaaacggcctttttgggaatctgatcgccctcagcctgggacttacgcctaacttcaagtctaattttgacctggctgaagatgccaaactccaactgtccaaggacacctacgatgacgatctggacaacctcctggctcagattggcgatcagtatgccgaccttttcctggccgctaagaacctcagcgatgcgatcctgctttctgacattctgagagtgaatacagagatcaccaaagccccgctctccgctagcatgatcaagcggtacgacgagcaccatcaggatctgacactgctcaaagccctggtgagacaacagcttcccgaaaagtataaagagattttctttgaccagtccaagaacgggtacgccggatatatcgatggcggcgcttctcaggaagagttctacaagtttattaaacctatcctggaaaagatggacgggaccgaggagctcctggtcaaactgaatcgcgaagatcttctccggaagcaaagaacgttcgacaacggaagcattccccaccagatccacctgggcgagctgcatgccatcctccgccggcaggaagatttttatcctttcctgaaagacaatagagagaagattgaaaagatccttacatttcgcattccctactacgttgggccgctggcgcggggaaactccagattcgcttggatgacccgcaaaagcgaggagacaatcaccccttggaattttgaagaggtggtggataagggcgcctctgcccaatccttcattgaacggatgaccaactttgacaaaaatctccccaacgagaaggtcctgcctaaacacagcctgctttatgagtacttcacagtgtataatgaactcacgaaggttaaatacgtgaccgaggggatgagaaagcccgcttttctgtctggagaacagaagaaagccatcgtcgatcttctcttcaagacaaaccgcaaagtgaccgttaagcagctgaaagaggactatttcaagaagattgaatgttttgatagcgtggagatctccggcgtcgaggaccggttcaatgcttctcttggcacataccatgacctgctcaaaatcattaaggataaagactttctggataacgaagagaatgaagacatcctggaggatattgtgcttaccctcacgctgttcgaagacagagagatgatcgaggaacggctgaagacatatgcccacctctttgatgacaaagtcatgaagcagctgaagcgcagacggtacaccgggtggggaagacttagccgcaaactgattaacggcatccgggataagcaatccgggaaaaccatcctcgacttccttaagagcgatggatttgcgaacagaaatttcatgcagctgattcatgacgattctctgacatttaaagaggacatccagaaggcccaggtgtccggccaaggggacagcctccacgaacacattgctaacctggccggctctcccgctatcaagaaaggcattctgcagaccgttaaggtggtcgatgagctcgtgaaagttatgggacgccataagcctgaaaatatcgtgatcgagatggccagagagaaccagacaacgcagaaagggcaaaagaactcccgggaacgcatgaaaagaattgaggaaggaatcaaggagctgggcagccagattcttaaggagcacccggtcgaaaatacccagctgcagaatgagaaactctacctgtattacctgcaaaacgggcgggacatgtatgtggatcaggaacttgacatcaatcgcctgtccgattacgacgtggatcatattgttccccagtctttcctcaaggacgatagcatcgacaacaaagtcctgacaagatccgataagaatcggggaaaatctgacaacgtgcctagcgaggaagtggtcaagaagatgaaaaattattggcgccaactcctgaacgcgaaacttatcacccagagaaaatttgacaatctgacaaaggccgagcggggcgggctctccgagctggataaagctggcttcattaagcgccagctggtggaaaccagacagatcacgaagcacgttgcccaaattcttgacagccggatgaacaccaaatacgatgagaacgacaagctgatcagagaagtgaaagtcattacactcaagtctaaactggtgtccgattttcgcaaggacttccagttctataaggttcgggagatcaataactaccaccatgctcacgatgcctacctcaatgccgtggtcggaaccgctctgattaaaaagtatcccaaacttgaaagcgagtttgtgtacggcgactataaggtttacgatgtgagaaaaatgatcgcgaagtctgagcaggaaatcgggaaggccacagctaaatatttcttttactccaacattatgaatttctttaagaccgagatcacgctggccaacggagaaattcgcaaacggcctctcatcgagacaaatggcgaaaccggggagattgtctgggacaagggaagagatttcgccacagtgcgcaaagtgctgagcatgccccaggtcaacatcgttaagaaaaccgaggtgcaaaccggcgggttttctaaggaaagcatcctgccgaagagaaattccgacaaacttattgctcggaagaaagattgggaccctaagaaatatggcggattcgacagccccacagtggcctactctgtcctggtggttgcgaaggtggagaagggcaaatccaagaaactcaagagcgtcaaagaactgctcgggatcacgattatggagcgctcctcttttgagaagaaccctatcgatttcctggaagctaagggatacaaagaggtgaagaaagaccttattatcaagctgcccaaatatagcctgtttgaactcgagaatggccggaagagaatgctggcctccgccggggaacttcagaagggaaacgagctggctctcccttctaaatacgttaatttcctgtatctcgccagccattacgagaagctgaaaggctcccccgaagataacgagcagaagcagcttttcgtggaacaacacaaacattatctggacgagatcattgaacagatctctgagtttagcaagcgggtcattctggcggatgctaatctcgacaaagtgctgtccgcctacaacaagcaccgcgataagccgatcagagagcaggccgaaaacattatccaccttttcaccctgacaaatctcggggctcctgccgcttttaaatatttcgacaccacaattgatcggaagcgctacaccagcacgaaagaggttctggacgccacactcatccatcaatctatcaccggcctgtacgaaaccagaattgatctttcccagctgggaggcgacaagcggcccgcggccacaaagaaggctgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4843 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaacttcaagattctgccgatcgcgattgacctcggagttaaaaatacaggcgtgtttagcgctttctaccagaaggggacatccctggagcggcttgataacaagaatggaaaagtgtatgaactgtctaaggacagctacacgctcctgatgaacaatcgcaccgccagacggcatcaacgcagaggcatcgatcggaaacagcttgtcaagcgcctgtttaaactcatttggacagagcagctgaacctggaatgggacaaggatacccagcaagccatctccttcctctttaatagacgggggttctcttttatcacagacggatatagccccgagtacctgaacattgtgcctgaacaggttaaggctatccttatggatattttcgacgattataatggcgaggacgatctggactcctacctcaaactggccaccgagcaggaatctaagatcagcgagatttataacaaacttatgcagaagatcctggaatttaaactcatgaagctgtgcacagatattaaagacgacaaggtgtccaccaagacgctgaaagagatcaccagctacgagttcgaactcctggctgattaccttgccaattattctgagtccctgaagacacaaaaatttagctacaccgacaagcagggcaacctcaaagaactgtcttattaccaccatgataagtataatatccaggagttccttaagcgccacgcgacaattaacgacagaatcctggataccctcctgacggacgatctggacatttggaattttaacttcgaaaaattcgattttgacaagaacgaggagaaactccagaatcaagaagataaggaccatatccaggcccatctgcaccacttcgtctttgctgtgaacaaaattaagtccgagatggccagcgggggacggcaccgctctcagtacttccaagaaatcacaaatgttcttgacgagaacaatcatcaggaaggctatctgaagaacttttgtgagaatctccacaacaaaaagtactccaatctgagcgtgaaaaaccttgtcaatctgatcgggaacctctccaatctggagctgaagcccctcagaaaatacttcaacgataagattcacgctaaggccgaccattgggatgaacagaaatttaccgagacatattgccactggatcctgggagaatggcgggtgggcgtgaaggaccaggataaaaaggacggggcgaaatactcttataaggatctttgtaatgagctgaaacaaaaggtcaccaaggccggactcgttgacttcctgctggaacttgatccttgccgcaccattcccccttacctcgacaacaacaatagaaaaccgcccaagtgtcagagcctgatcctgaaccctaaatttctcgataatcagtatcccaactggcagcaatacctgcaggagcttaagaaactgcagtccattcagaattatctcgacagcttcgagacagatctgaaggtgctgaagtcttccaaagaccaaccttactttgtggaatacaagagctctaaccagcagatcgctagcggccagcgggactataaagatcttgacgccagaatcctccaattcatttttgatcgcgtcaaggcttccgacgagctgctgctcaatgaaatctacttccaggccaaaaagctgaagcagaaagcctctagcgagcttgagaagctggaatccagcaaaaagctcgatgaggtgattgctaactctcaactgtcccagatcctgaaaagccagcatacgaatggcattttcgaacaggggacctttcttcacctcgtttgcaagtattacaagcaacggcagagagcgcgcgactctcggctgtatatcatgcccgagtacagatatgataaaaagctgcataaatacaacaatacaggacgcttcgacgatgacaaccagctcctgacctactgtaatcacaagccgcggcagaaaagatatcaacttctgaacgatctcgccggcgtgctgcaggtctcccctaattttctgaaggacaaaattgggagcgatgacgaccttttcatctccaagtggctcgtggaacacatccgcggatttaagaaggcttgcgaggattctctgaaaattcagaaagacaaccggggcctgctcaaccataagatcaatattgccagaaacacaaaagggaagtgtgagaaggaaatcttcaatctgatttgcaaaatcgagggaagcgaagataagaaaggcaactacaagcacggccttgcctatgagctgggggttctcctgtttggagaacccaatgaggcttccaaacctgagttcgaccgcaagatcaagaaatttaactctatttacagcttcgcccagatccaacagattgcgtttgctgaacggaagggcaatgccaacacctgtgccgtgtgctccgctgataatgcccatagaatgcagcaaatcaaaattacggagcccgtcgaagacaacaaggataaaatcatcctgagcgctaaggcccagcggcttcccgcgattcctacacgcatcgtggacggggccgtcaagaaaatggctaccattctggccaagaatatcgtggatgacaactggcagaatattaaacaggttctctctgctaagcaccaactgcacatcccgatcattaccgagtccaacgccttcgaatttgagcccgcgctcgccgatgtgaaaggaaagagcctgaaggacagacggaaaaaggctcttgagagaatctctcctgaaaatattttcaaagacaagaacaaccgcatcaaagagttcgccaagggcatttccgcttatagcggggccaatctgacagatggcgactttgatggagccaaagaggaactcgaccatatcattccccggtctcacaagaagtacggcaccctgaacgatgaggctaatctgatctgcgtcacaagaggggacaacaaaaataagggaaaccgcatcttctgtcttagagatctggcggacaattataaactcaagcagtttgaaacgaccgatgacctggagattgagaaaaagatcgccgatacaatttgggacgctaacaagaaagatttcaagtttggcaattaccggagcttcatcaacctcacccctcaggaacagaaagcctttcgccatgccctgttccttgctgacgaaaatcccattaagcaagccgtgatcagagcgatcaacaatcggaaccgcacatttgttaatgggacccagagatacttcgctgaggtgctggccaacaatatttatctccgggccaaaaaggagaacctgaacacggacaagatctcctttgattacttcggcattccgaccatcggaaatgggcgcggcattgctgaaatcagacagctgtatgagaaagtcgacagcgatatccaggcctacgcgaagggagacaaacctcaggcttcttattcccaccttattgatgccatgctggccttctgcatcgctgccgacgaacatcggaacgatggcagcattgggctcgagatcgacaagaattactccctgtatcccctcgataaaaacacaggagaagtgtttaccaaggacattttctctcaaatcaagattacagataatgagtttagcgacaaaaagctggtgcgcaaaaaggctatcgagggcttcaacacccacagacagatgacgcgggatgggatctacgccgaaaattaccttcctattctgatccacaaagagctgaacgaagttagaaagggatatacatggaaaaattccgaggaaattaagatctttaagggcaaaaagtacgacattcagcaactcaacaatctggtctattgtcttaaattcgtggacaagcccatctctatcgatattcagatcagcaccctggaggagctccgcaacattctgacaaccaataacatcgcggccaccgctgaatactattacattaatctcaaaacacagaagctgcatgagtattacatcgaaaactacaacacggcccttgggtataagaaatactccaaggagatggagtttctgcggtctctggcttatagaagcgaacgcgtgaaaatcaagtccattgacgatgtcaaacaagtgctcgacaaggatagcaatttcatcattggcaagatcaccctgccttttaaaaaggagtggcagcggctttacagagaatggcagaacacaaccattaaagacgattatgagttcctgaagtctttcttcaatgttaaatccatcacaaagctccacaagaaagtgcgcaaggactttagcctgcccatttctaccaacgaaggaaaattcctcgtcaagcggaaaacgtgggataataacttcatctaccagatcctgaatgactccgatagcagagccgacggcacaaagccgtttattcctgccttcgacatctctaaaaacgagattgtggaggctatcattgattcctttaccagcaagaatatcttctggcttcccaagaacatcgaactgcaaaaagttgacaataagaacatttttgcgatcgatacctccaaatggttcgaggtggaaacacccagcgacctgcgcgatattgggatcgccaccattcagtataagatcgacaataactctcggcctaaagtcagagtgaagctcgattacgttatcgacgatgacagcaagattaattactttatgaaccattccctgcttaaatctcggtatccggataaggtgctggagatcctcaaacagagcacaattatcgaatttgagtcctctggatttaacaagacgattaaagagatgctgggcatgaagctcgctgggatctacaatgaaaccagcaacaataagcgccccgccgccaccaaaaaggctggacaggccaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4844 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagcggaactacattctgggactcgacatcggcattaccagcgttgggtatggaatcattgattacgagacacgcgacgtgatcgatgcgggcgtgagactgttcaaagaagctaatgtcgagaacaatgaagggcggcgctccaagagaggagcccggcgccttaagagacggcgcagacatcggatccagcgcgtgaaaaagctgctctttgactataacctgcttacggatcactctgagctgagcggcattaatccgtacgaagccagagttaaaggcctctcccaaaagctgtctgaggaggagttcagcgctgccctgctccatctggctaaacggcgcggggtgcacaacgtcaatgaagtggaagaggacaccggaaacgagctttccacaaaggaacagatctctagaaatagcaaggccctggaggaaaaatatgttgcggagctccagctggaacggcttaagaaagatggcgaggtgagagggtccattaaccgctttaagaccagcgactacgtcaaagaggccaagcagctgctcaaagtgcaaaaggcttatcatcagctggatcagtctttcatcgacacatacattgatctgctcgaaacccggagaacatactatgagggacccggcgaagggtccccttttggatggaaggacatcaaagagtggtacgaaatgctgatgggccactgcacctatttccccgaggagcttcgcagcgtgaagtacgcctataatgctgatctgtacaacgccctcaatgacctgaacaatcttgtcattacgcgggacgaaaacgagaaactggaatattacgagaagtttcagatcatcgaaaacgttttcaaacaaaagaagaaacctaccctcaagcagattgcgaaagagatcctggtgaatgaggaagatattaagggctacagagtgacatctaccgggaaacccgagtttacaaacctgaaggtctatcacgacatcaaggatattaccgcccgcaaagaaatcatcgagaatgctgagctcctggaccagattgccaagatccttacgatttaccagtccagcgaagatatccaagaggaactgacaaacctcaattctgagctgacccaggaagagattgagcagatctccaaccttaaaggatatacaggcacccataatctgagcctcaaggctatcaacctgattctggacgaactctggcacaccaatgataaccaaatcgccattttcaatcggctgaaacttgtgcctaagaaggttgacctgtcccagcagaaagagatcccgacaacgctcgtggatgactttattctgtctcccgtcgtgaagcgcagcttcatccagtccattaaagttatcaacgccatcattaagaaatacgggctgcctaatgatatcattatcgaacttgctcgcgagaagaacagcaaagacgcgcaaaagatgattaatgaaatgcagaagcggaacagacagaccaacgagcgcatcgaggaaatcattcggacaaccggaaaagagaatgccaagtatctcatcgagaaaattaagctgcatgacatgcaggaaggcaaatgtctgtactctctcgaagctatccccctggaggatcttctgaacaatccttttaactatgaggtggaccacattatccccagatccgtcagcttcgataattctttcaacaataaggtgctcgtcaagcaagaagagaacagcaaaaaggggaatcggacaccgtttcagtacctgtcctctagcgactccaaaatcagctacgaaaccttcaagaaacacattctgaaccttgccaagggaaagggccgcatctctaaaacgaagaaagagtatctcctggaggaaagagatattaatcggttttccgtgcagaaggacttcatcaacagaaatctggttgatacacgctacgccacccggggcctcatgaacctgcttagaagctattttcgcgtgaataacctggacgtcaaagtgaagtctattaacgggggattcacctcctttctcagacggaagtggaaattcaagaaagagcgcaataagggctacaaacatcacgctgaagatgccctgatcatcgcgaacgctgactttattttcaaggagtggaaaaagctggataaggccaaaaaggttatggaaaatcagatgtttgaggagaaacaagccgaaagcatgcctgagatcgaaacagagcaggaatataaggagattttcatcacaccccatcagattaaacacatcaaggactttaaggattacaaatattcccatagagtggacaagaaacctaaccgggagcttattaatgacaccctctactctacgcgcaaggatgacaaagggaacaccctgatcgtcaataacctgaatggactctacgataaggacaacgataagctgaagaaacttatcaataaaagccccgaaaagctgctcatgtatcaccacgacccccagacataccaaaaactgaagctgattatggagcagtatggcgatgaaaagaaccctctttacaaatattacgaggaaaccgggaattatctcacaaagtactccaaaaaggacaacggcccggtgatcaaaaagattaagtactatggaaataaactgaacgctcatctggatatcaccgacgattaccccaactctagaaataaggtggttaaactcagcctgaagccttatcggttcgacgtctaccttgataacggcgtgtataaattcgtgacggtcaagaatctggacgtgattaaaaaggagaactactatgaggttaattccaagtgctacgaagaggccaaaaagctcaaaaagatcagcaaccaggctgaatttatcgcctctttctacaataacgacctgattaaaatcaatggggagctgtatcgcgtgattggagtcaacaatgatcttctgaacagaatcgaggtgaatatgattgacatcacctaccgggaatatctcgagaacatgaatgataagagaccccctagaatcattaagacaatcgcgtccaaaacccaaagcattaagaaatactctacagacatcctgggcaacctctatgaagttaagtccaaaaagcacccccagattatcaagaaagggaagcggccggccgctaccaaaaaggccggacaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4845 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccctgttcaacaagtgcattatcattagcatcaatctcgacttttccaacaaagagaagtgtatgaccaagccgtactctattggactggatatcggcacaaatagcgttgggtgggcggtgatcacggacaactataaagtgccctccaagaaaatgaaggtccttggaaatacctctaaaaagtacattaagaaaaacctgctcggcgtgctgcttttcgatagcgggatcacagctgaaggacggcgcctgaagagaaccgcccggcgcagatatacacggcgcagaaatcggattctctacctgcaggagatcttttccaccgaaatggccacactggacgatgctttctttcaacgcctcgacgattctttcctggttcctgacgataaaagagacagcaagtatcccatttttggcaaccttgtggaggaaaaagtctaccatgatgagttccctaccatctatcatctgcggaagtacctcgccgactccacgaaaaaggctgatctgcgccttgtgtacctggccctcgcgcacatgattaagtatagaggccactttctgatcgagggggagttcaatagcaaaaacaatgacatccagaagaactttcaggacttcctggatacctacaatgccatttttgaatctgacctctccctggaaaacagcaaacagcttgaggagatcgttaaggataaaatttctaagctggaaaagaaagaccggatcctcaagctgttccccggagagaaaaattccggcattttcagcgaatttcttaagctgatcgtggggaaccaagctgatttccgcaaatgctttaacctcgacgagaaggcctctctgcatttctccaaggaaagctatgatgaggacctggagacactcctgggatacatcggcgatgactattccgatgtctttcttaaagctaagaaactgtacgacgccattctcctgtctgggttccttaccgtgacagacaatgaaaccgaggcgcctctgagctccgccatgatcaagagatataacgaacacaaagaggatctcgctctgctgaaggaatacattcggaatatcagcctcaagacgtacaacgaggtgtttaaagacgatacaaagaatggatatgccggctacattgacggcaaaaccaaccaggaggatttctatgtctacctgaagaatcttctggctgaatttgagggggccgactatttcctcgaaaagatcgatagagaggactttctgcgcaagcagcggacattcgataacggatctatcccgtaccagattcatctgcaagaaatgagagccatccttgacaaacaggctaagttttatcccttcctcgcgaagaataaagagcgcattgagaagatcctgaccttccggattccttactacgttggccccctggccagagggaactccgattttgcttggagcatccgcaaacggaatgaaaagattaccccttggaacttcgaggacgtgatcgataaagaatctagcgccgaggcctttatcaatagaatgacatccttcgacctctatctgcccgaggaaaaggtgcttccgaagcactctctgctctacgagacgtttaacgtctataatgaactgaccaaagtgcgcttcattgctgagagcatgcgggactaccagtttctggattccaagcagaaaaaggacatcgttagactttatttcaaagataagcgcaaggtgacagacaaagatattatcgaatacctccacgccatttatggatacgacggcatcgagctgaaggggatcgagaaacaatttaacagctctctgtccacctaccatgatctcctgaacattatcaatgacaaggagttccttgatgacagctctaacgaagcgattatcgaagagattatccacacactgaccatctttgaagatcgggagatgattaaacagagactctccaagttcgagaatatctttgacaagagcgtcctgaaaaagctgtcccggcgccactatacgggatggggcaaactttctgctaagctcattaacggcatcagagatgaaaagagcgggaatacaattctggactacctgatcgacgatggaatctccaaccggaatttcatgcagctcattcatgacgatgccctgtctttcaagaaaaagatccaaaaggcccagattatcggcgacgaggataaagggaacattaaggaagtggttaaaagccttcctggatcccccgctatcaagaaaggcattctgcagagcatcaagatcgtggacgagctcgtcaaggtgatgggcgggagaaaacctgaatctattgtcgtggagatggcccgcgagaatcagtataccaaccaaggaaagtccaatagccagcagcggctgaaaagactggaaaagtctcttaaagagctcggctccaagatcctgaaggaaaacattcccgctaaactgagcaagatcgataataacgccctccagaatgaccgcctgtacctttattacctgcaaaacgggaaagatatgtataccggagacgatctcgacattgacagactgtctaactacgatatcgaccacatcattccccaggcgtttctgaaggataatagcatcgacaacaaagttcttgtgtccagcgcctctaatcggggcaagtccgatgacttccctagcctggaggtcgtgaagaaacgcaagacattttggtaccagctcctgaaatccaagctcatttctcagagaaaattcgataacctgaccaaggctgagcgcgggggacttctgccggaagacaaggccggctttatccaacggcagctcgttgagacaagacagattacgaaacatgtggctcggctgctggatgaaaagttcaataacaaaaaggacgagaataaccgcgccgtcagaaccgtgaaaatcatcacacttaagagcaccctggtgtcccagtttcggaaagatttcgaactctataaggttcgcgagattaatgactttcaccatgcgcacgatgcctacctgaacgctgtcatcgcctctgctctcctgaagaaatatcccaaacttgagcctgagttcgtgtacggggactatcccaaatacaatagctttagagaacggaagtccgccacagaaaaagtgtatttctactctaacattatgaatatcttcaaaaagagcatttccctggccgacggcagagtcatcgagcgccctctcattgaagtgaacgaggagaccggagaaagcgtttggaataaagagtctgatctggctacggtgcggagagtcctgtcctacccccaagtgaacgttgtgaagaaagtcgaggaacagaaccacggccttgaccgcgggaagccgaaaggactgtttaatgcgaacctcagctctaagcctaagcccaattccaacgaaaatctggtgggcgccaaagagtatctcgatcctaagaaatacgggggatatgctggcatcagcaactctttcgccgttctggtgaaggggaccatcgagaaaggcgccaagaagaaaattacaaatgtccttgaatttcagggaatctccattctggaccggatcaactacagaaaggataaactgaatttcctcctggagaagggctataaagacattgaacttatcatcgagctgcccaagtacagcctctttgagctgtccgatgggagccgccggatgctcgcttctattctgagcaccaacaataaaagaggagaaatccataagggcaaccaaattttcctttcccagaagtttgtgaaactgctgtatcacgccaagcgcatctctaatacaattaacgagaatcatcggaaatacgtggaaaaccacaagaaagagttcgaggaactcttttactatatcctggagttcaatgaaaactacgtcggggcgaagaagaacggaaaacttctgaatagcgcttttcagtcctggcagaaccactctatcgacgagctctgtagctccttcattggccctaccgggtctgaaagaaagggcctgtttgagctcacgagccggggatccgccgccgatttcgagttcctgggcgttaaaatcccccgctatagagactacacaccgagctctcttctgaaggatgctaccctgattcatcaatccgtgacagggctctatgaaacccggatcgacctggccaaacttggagagggcaagcgccctgcggctaccaagaaagccgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4846 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcctggtacgcgagcctgatgtccgctcatcacctccgggttggaattgacgtgggcacccattctgtggggctggccacacttcgcgtcgatgaccacggaacgccgatcgagctgctcagcgccctgtcccatattcacgattctggcgtggggaaggaagggaaaaaggaccacgataccagaaagaaacttagcggcatcgctcggcgcgccagacggctgctccatcaccgcagaacacagctgcaacagctggacgaggttctccgggatctgggcttccccattcctacccccggggaatttcttgacctgaacgagcagacagatccttatcgcgtgtggagagtccgggctcgcctcgtggaagagaagctgcccgaggaacttagaggacctgccatctccatggcggttcggcatatcgcccgccacagaggctggcggaatccgtactctaaagtggagagcctgctctcccccgctgaagagagccctttcatgaaggccctgagagagcgcattctggctaccacaggggaagtcctcgacgatggaatcacccccggccaggccatggcgcaagtggccctgacgcacaacatttctatgcgggggcctgagggaatccttggcaaactgcatcagtccgacaatgctaacgaaattagaaagatctgcgcccgccagggcgtgagccccgatgtctgtaagcagctcctgcgggctgtttttaaagccgactctccgagagggtccgccgtgagccgcgtggctcctgacccccttcctggacaaggctctttccggagagcgcccaagtgcgatcccgagtttcagcgcttccggattatctccatcgtcgccaatctgagaattagcgaaaccaaaggggagaaccgccctctcacagctgacgagcggagacacgtggttacctttctgacagaagattcccaggccgacctgacctgggtggatgtcgccgagaagctcggagtgcatcggcgcgacctgagaggcacggctgttcacacagatgacggggaacggtctgccgcgagaccgcccatcgatgctaccgaccgcattatgcggcagacaaaaatcagctcccttaagacctggtgggaggaagccgatagcgagcaaagaggagccatgattcgctatctgtacgaggaccctaccgactctgaatgtgctgagatcatcgccgaactccccgaggaagatcaggctaaactggactcccttcatctgcctgccggcagagcggcctatagccgggagtctctcacagctctgagcgatcacatgctggccacgaccgacgatctccacgaggctcgcaagagactgttcggcgtggacgattcctgggcgcccccggccgaagccattaatgctcctgtcgggaacccctctgtggaccggacacttaagatcgtcggacgctacctgagcgccgtggagtccatgtggggcacccctgaagttattcatgtggagcacgtcagagatgggtttacaagcgagcggatggctgacgaacgcgataaagccaatagacggcgctataacgacaatcaggaggccatgaagaaaatccaaagagattacggaaaggaaggctacatttctcggggagacatcgtgagactcgacgctctggagctgcagggctgcgcgtgtctttattgcggaaccacgatcggctaccatacatgtcagctcgatcacattgttccccaggccgggcctggatccaacaatcgccggggcaacctggtggctgtctgcgaaagatgtaatcgcagcaaatctaacacccccttcgccgtgtgggcccaaaagtgcgggatcccgcacgtgggagttaaggaggctattggccgggtcagagggtggcgcaaacagacccctaacacatccagcgaggacctgacccggctcaagaaagaagtgatcgccagactgcgccggacacaggaggatcccgaaattgacgagagatccatggaatctgtggcgtggatggctaatgagcttcatcaccggatcgccgccgcttatcccgagacgaccgtcatggtgtaccgcggcagcattacagccgcggctagaaaggccgccggaatcgattcccggatcaacctgattggcgaaaaagggcgcaaggacagaatcgatcggagacatcacgctgttgacgcctctgtggtcgctctcatggaggccagcgtggcgaagaccctggccgaacgctccagcctgcggggagagcagagacttacaggcaaagaacaaacctggaagcagtatacggggtctaccgttggagctcgcgagcattttgagatgtggcggggccacatgctccacctgacagaactgttcaatgagagactcgccgaagataaagtgtacgtcacccagaacattcgcctgcggctttccgacgggaatgctcatacagtgaaccctagcaagctggtttctcacagactcggcgatggactgaccgtgcagcaaatcgaccgcgcctgtacgccggccctgtggtgcgctcttacaagagagaaagattttgacgagaagaatggcctccccgcgcgggaagaccgcgccattagagtccatgggcacgagatcaagtccagcgattatatccaggtgttctctaaacggaagaaaaccgacagcgatcgcgacgaaacacctttcggagctattgccgtgagaggcgggtttgtcgagatcggaccctccattcatcacgcccggatctacagagttgaaggcaagaaacctgtgtacgctatgctgcgcgtgttcacccacgatctgctcagccagcggcatggggacctgttttctgccgtcattccccctcagtccatcagcatgagatgcgcggagcccaaacttcgcaaagctatcaccacaggcaacgccacgtatctgggatgggtggttgtgggcgatgagctcgaaattaatgtcgactccttcaccaagtacgccatcgggcggtttctggaggatttcccgaacacaaccagatggcggatttgtggatatgacacaaattctaagctgacccttaaacctatcgtgctcgctgccgaaggcctggagaaccccagctccgcggttaatgaaattgtggagctgaaggggtggcgcgtcgctatcaacgtgctcacgaaagttcaccctacagtggtcagacgggatgccctgggacgccccagatactctagccggtccaatcttccgacctcttggaccatcgagaagcgccctgccgctacaaagaaggccggccaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4847 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaccaagccgtacagcattggactggacatcggcacaaactccgttgggtgggcggtgacgaccgataattataaagtgccctctaagaagatgaaagtcctcggaaacacaagcaagaaatacattaagaaaaatctgcttggcgtgctcctgttcgactccgggatcaccgctgagggacggcgcctgaagagaacagcccggcgcagatatacccggcgcagaaaccggattctttacctgcaggaaatcttttctacagagatggccaccctcgatgacgctttctttcaacgcctggatgacagcttcctggttcctgatgacaagagagattccaaatatcccatctttggcaatctcgtggaagagaaggcctaccatgacgagttccctacgatttatcatctgcggaaataccttgctgattctaccaagaaagccgacctgcgcctcgtctacctggcgcttgcccacatgatcaagtatagaggccactttctgattgagggggagttcaacagcaaaaataacgatatccagaagaattttcaggacttcctcgacacatacaacgctatttttgaatccgatctgagcctggaaaattctaagcagctcgaagagatcgtgaaagacaagatttccaaactggagaagaaagatcggatccttaagctgttccccggagaaaagaacagcggcatcttttctgagttcctcaaactgattgttgggaatcaagccgacttccgcaagtgctttaaccttgatgaaaaggcttccctgcatttcagcaaagagtcttatgacgaagatctcgagaccctgctgggatacatcggcgacgattattccgacgtgtttctcaaagccaagaagctgtacgatgcgattcttctgagcgggttcctcacagtcaccgacaatgagacggaagcccctctgtcctctgctatgatcaaaagatataacgagcacaaggaagaccttgccctgctcaaagagtacattcggaacatcagcctgaagacatacaatgaagtgtttaaagatgacaccaagaacggatatgctggctacatcgatggcaagacaaatcaggaggacttctatgtgtacctgaaaaagctcctggccgagtttgaaggggccgattatttccttgagaaaattgacagagaagattttctgcgcaagcagcggaccttcgacaacggatccatcccgtaccagattcacctccaagagatgagagctatcctggataaacaggcgaagttttatcccttcctggccaaaaataaggaacgcattgagaagatccttacctttcggatcccttactacgtcggccccctcgctagagggaacagcgacttcgcctggtctattcgcaaacggaatgagaagatcacaccttggaacttcgaagatgttattgacaaagagtccagcgccgaggcttttatcaatagaatgacgtctttcgatctgtatctgcccgaagagaaggtgctcccgaaacatagcctgctttacgaaacctttaacgtgtataatgagctgacaaaggtccgcttcattgccgaatccatgcgggactaccagtttctcgactctaagcagaaaaaggatatcgtgagactgtatttcaaagacaagcgcaaagttaccgataaggacattatcgagtacctgcacgcgatctatggatacgatggcattgaacttaaggggatcgagaaacaatttaacagctccctcagcacataccatgacctgctgaatattatcaacgataaggagttcctcgacgattcttccaatgaagctattatcgaggaaatcattcacaccctgacgatctttgaggaccgggaaatgattaaacagagacttagcaagttcgagaacatctttgataaatctgtgctgaagaagctctcccggcgccactatacaggatggggcaaactgagcgccaagctgattaacggcatcagagacgagaaatccgggaataccatccttgattacctcattgacgacggaatctctaaccggaatttcatgcagctgattcatgatgacgccctgagctttaagaaaaagatccaaaaagctcagattatcggcgatgaagacaaggggaacatcaaggaggtcgtgaaatccctccctggatctcccgccattaagaaaggcatcctgcagagcattaagatcgttgatgaacttgtgaaagtcatgggcgggagaaagcctgagtccattgtggtcgaaatggctcgcgagaatcagtataccaaccaaggaaagagcaattctcagcagcggctgaaaagactcgagaagtccctgaaagaactgggcagcaagatccttaaagagaacattcccgccaagctctctaagatcgacaataacgcgctgcagaatgatcgcctgtacctctattacctgcaaaacgggaaagacatgtatacaggagatgaccttgatatcgacagactgtccaattacgacattgatcacatcattccccaggccttcctcaaggacaacagcatcgataataaagtgctggtttctagcgcttccaaccggggcaagagcgacgatgtgccttctctggaagtcgtgaaaaagcgcaagaccttctggtaccagcttctgaaatccaagctcattagccagagaaaatttgacaacctgacaaaggccgagcgcgggggactctccccggaggataaagctggcttcatccaacggcagctggttgaaacgagacagatcaccaagcatgtggcccggcttctggacgagaagtttaataacaaaaaggatgaaaataaccgcgcggtcagaacagtgaaaattatcaccctcaagtctacactggtgagccagttccggaaagactttgagctgtataaggttcgcgaaattaatgatttccaccatgcccacgacgcttaccttaacgccgtcgtggcttccgccctgctcaaaaagtatcccaagctggagcctgagtttgtgtacggggattatcccaaatacaattctttcagagaaagaaagagcgccaccgagaaagtctatttttactccaacatcatgaatattttcaagaaatctatcagcctcgctgacggccgggtgatcgaacgccctctgattgaggttaacgaagagacgggagagtccgtgtggaataaggaaagcgaccttgcgaccgtccggagagtgctgtcttacccccaagttaacgtggtcaagaaagtggaggaacagaatcacggcctcgatcgcgggaagccgaaaggactgtttaacgccaatctgtccagcaagcctaaacccaactctaacgagaatcttgttggcgctaaggaatatctggaccctaagaaatacgggggatatgccggcatctccaacagcttcacagtgctcgtcaaggggaccattgagaaaggcgccaagaaaaagatcacaaatgtgctggagttccagggaatttctatcctcgatcggattaactacagaaaggacaaactgaattttcttctggaaaagggctataaagatatcgagctgatcattgaactccccaagtactccctgttcgagcttagcgacgggtcccgccggatgctggctagcatcctctctaccaacaataaaagaggagagattcataagggcaaccaaatctttctgagccagaaattcgtgaagctcctgtatcacgccaagcgcatttccaatacgatcaacgaaaatcatcggaaatacgtcgagaaccacaagaaagaatttgaggaacttttctactatatcctggagtttaatgagaactacgttggggcgaagaaaaatggaaagctgctcaactctgctttccagagctggcagaatcactccattgatgaactgtgttctagctttatcggccctacagggtccgagagaaagggccttttcgaactgacctctcggggaagcgccgccgactttgagttcctcggcgtgaaaattccccgctatagagattacacaccgtccagcctgctcaaggacgctaccctgatccatcaatctgtgaccgggctttatgaaacacggattgatctggccaaactgggagagggcaagcgccctgcggctacgaaaaaggccgggcaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4848 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaacagcattaattacatcctgggactcgacattggcatcgcctccgttgggtgggccatggtggagattgatgaagaggaaaaccccatccggctgatcgaccttggagtgcgcgtctttgagagagctgaagtgcctaaaaccggcgattctctggccatggctcggcgcctcgccagaagcgttcggcgcctgacaagacggcgcgcgcatagacttctgcggacgcgcagactcctgaagcgggagggggtgctgcaggccgctaatttcgacgagaacggactcattaagtccctgcccaataccccttggcaacttcgcgccgctgccctggatagaaaactcacacccctggaatggtctgcggtccttctgcacctcatcaagcatcggggctatctgagccagcgcaaaaacgagggcgaaaccgccgacaaggagctgggggctctcctgaaaggagtggccggcaatgctcacgcccttcagacaggggattttagaacccctgccgagctggctctcaacaagttcgaaaaggagtccggacatattcggaatcagagatctgactacagccacacattttcccgcaaagatctgcaagcggaacttatcctcctgttcgagaagcagaaagaatttggcaacccgcacgttagcgggggactgaaggagggcattgagaccctgctcatgacgcagcggcccgccctgtctggcgacgctgtgcagaaaatgcttgggcattgcaccttcgaacctgccgagcccaaggccgctaaaaatacatataccgccgaaagatttatctggctgacaaagctcaacaatctgcgcattcttgagcaaggatccgaacggcctctgaccgatacggagagagcgacactcatggacgagccctaccgcaagagcaaactgacctatgctcaggcccggaagctgctcggcctggaagatacagccttctttaaagggcttagatacggaaaggacaacgctgaggcctctaccctgatggaaatgaaggcttatcacgccatctcccgcgcgctcgagaaggaaggcctgaaggacaaaaagagcccgctgaatctttctcctgagctccaggatgagatcgggaccgccttctccctgtttaaaacagacgaagatattacgggacggctgaaggacagaatccagcccgagattctcgaagctctgcttaaacatatcagcttcgataagttcgtccaaatttccctgaaggccctccggcgcatcgtgcctctgatggagcagggcaaaagatacgacgaggcttgtgccgaaatctacggcgatcactatgggaagaaaaacaccgaggaaaagatttacctgcctcccatccccgcggacgagattcggaacccggtggtccttagagccctctctcaggctcgcaaagttatcaatggagtggtgcggagatatggcagccccgcccgcattcacatcgaaacagctagagaggtcgggaagtcctttaaggatcggaaagagatcgaaaagcgccaagaggaaaacagaaaagaccgggagaaggccgccgctaaattccgcgaatactttcctaatttcgtgggagagcccaagagcaaagatattctgaagctgagactctatgagcagcagcatggcaagtgcctgtactctgggaaagaaatcaaccttggccggctgaatgagaagggatatgttgaaattgaccacgcgctccctttttcccgcacctgggacgatagcttcaacaataaagtgctggtcctgggctctgagaaccagaataaggggaaccaaacaccctacgaatactttaatggaaaagacaacagcagagagtggcaggagttcaaggcccgggtggaaacctcccgctttccgagatctaagaaacagcggatccttctccagaagttcgatgaggacggctttaaagaaagaaatctgaacgatacgcgctatgttaatcggttcctgtgtcaatttgtggctgacagaatgcgcctcacagggaagggcaaaaagcgggtcttcgccagcaacggacagattaccaacctgcttagagggttctggggcctgcgcaaggtgcgggccgagaatgatagacatcacgctctcgacgccgtcgtggttgcgtgctccaccgtggctatgcagcagaaaatcacacgctttgtccggtacaaggagatgaacgccttcgatggaaaaaccattgacaaggaaacaggcgaggtgctgcatcagaaaacgcactttcctcagccctgggagttctttgcccaggaagttatgatcagagtgttcgggaagcctgatggaaagcccgaatttgaggaggctgacaccctggaaaaacttcggacactcctggccgagaagctgagctctcgccctgaagcggtccacgagtatgtgacacccctcttcgtgtccagagctccgaatcggaaaatgagcggccaggggcatatggaaaccgttaagtctgccaaacgcctggatgagggagtctccgtgcttagagtgcctctgacccaactcaagctgaaagacctggagaagatggtcaaccgggaaagagagcccaaactttacgaagccctgaaagctcgcctcgaggcccacaaggacgatcccgctaaagcctttgcggaacctttctataagtacgacaaagccggcaatcggacgcaacaggtgaaggctgttagagtggagcaagtccagaagaccggggtgtgggttcgcaaccataatggcatcgccgataacgctacaatggtgcgggtcgacgtgtttgagaaaggagataagtattacctggttccgatttacagctggcaagtggccaaaggcatcctccccgacagagccgtcgtgcaggggaaggatgaagaggactggcagctgattgatgactccttcaattttaaattctctcttcaccctaacgatctggtggaagtcatcaccaagaaggctcgcatgttcggatattttgcgagctgtcaccggggcacagggaatattaacatcagaatccatgacctcgatcacaaaattggaaagaatggcatcctggaggggattggcgttaaaaccgccctgtccttccagaagtaccagatcgacgagcttggaaaagaaattcgcccctgcagactgaagaagcggcctcccgtgcgcaaaagacctgctgccacgaagaaagccggccaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4849 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacaccattggactggacatcggcacaaacagcgttgggtgggcggtgctcacggatcagtatgacctggtgaagcggaagatgaaaattgctggagattccgagaagaaacaaatcaagaaaaatttctggggcgtccgcctttttgacgaagggcagaccgccgccgatagacggatggctcgcacagccagacggcgcattgagagacggcgcaacagaatctcttacctgcagggaatcttcgctgaagagatgagcaagaccgacgccaatttcttctgccggctctccgattctttttatgtggacaacgaaaagcgcaatagcagacatcccttctttgcgacaattgaggaggaagttgagtaccacaaaaactatcctaccatctaccatctgcgggaggaacttgtcaattcctctgagaaggccgatctgcgcctcgtctatctggctctggcccacattatcaaatacagaggcaacttcctcattgaaggcgctctggacacacagaataccagcgtggatgggatctacaagcaatttattcagacgtataaccaggttttcgcctccggaatcgaggacggcagccttaaaaagctggaagataataaagacgtggcgaagatcctcgtcgagaaggtgacccggaaagaaaagctggagcgcattcttaaactgtaccccggggagaagtctgccggaatgtttgctcagttcatctccctcattgtgggcagcaaagggaactttcaaaagcctttcgacctgatcgaaaagtctgatattgagtgtgccaaagactcctatgaagaggatctggaaagcctcctggctcttatcggagacgagtacgccgagctgttcgtcgccgctaagaatgcgtattctgccgttgtgctctccagcatcattacagtggctgaaaccgagacaaacgccaaactgtccgcctctatgatcgaaagatttgatacccatgaggaagaccttggcgagctgaaggctttcattaaactccatctgcccaagcactacgaggaaatctttagcaatacggagaagcacggctatgccgggtacattgatggaaaaacaaagcaggcggacttctacaaatatatgaagatgaccctggaaaacatcgagggcgctgattactttatcgccaaaattgagaaggaaaacttcctccggaagcagagaacatttgacaatggggccatccctcaccagctgcatcttgaggaactggaggctattctccaccaacaggccaaatattacccgttcctgaaggaaaactatgataaaatcaagtcccttgtcacctttcgcattccctacttcgtgggacctctggctaatggccagagcgagtttgcctggctcacccggaaagcggacggggagatcagaccctggaacattgaagagaaggttgacttcggaaaatctgccgtggattttatcgaaaagatgacaaataaggacacgtatctgcctaaagagaacgtcctgcccaagcactccctctgctaccaaaaatacctggtgtataatgaacttaccaaggttcgctacatcaacgatcagggcaaaacaagctatttctctggccaggagaaggagcagattttcaatgacctgtttaagcaaaaacggaaggtgaaaaagaaagatctcgaactgttcctgagaaacatgagccatgtcgagtccccgaccatcgaagggcttgaggactcttttaatagctcctacagcacatatcacgatctcctgaaggtgggaattaagcaggaaatcctggacaaccctgtcaataccgagatgctcgagaacattgtgaaaatcctgacggttttcgaagataagcgcatgatcaaagagcagcttcagcaattttctgacgtgctggatggcgtcgtgctcaagaaactggaacggagacattacacagggtggggacgcctgtccgctaagctcctcatgggcattcgggacaagcagagccacctgaccatcctggattatctcatgaatgacgacgggctgaacagaaaccttatgcagctgattaatgattctaacctctccttcaaaagcatcattgagaaggagcaggttaccacagccgacaaagatatccaatccatcgtggctgacctggccggctctcccgcgattaagaaaggaatcctgcagagccttaagattgtcgatgaactcgtgtccgtgatgggctaccctccccagaccatcgttgtcgagatggcccgggaaaatcagacaacggggaaaggaaagaacaattctcgccccagatacaagagcctggagaaagctattaaggaatttggctcccaaatcctgaaagagcatcctaccgacaaccaggagctccggaataacagactgtatctttactatctgcagaatgggaaggatatgtacacaggacaagacctcgatatccacaacctgagcaattatgacattgatcacatcgtgccgcagtctttcattaccgacaactccatcgataatctggtgcttacaagctctgccggcaaccgcgaaaaaggggacgacgtgccccctctcgagattgtgcggaagagaaaggtgttttgggaaaaactgtaccagggcaatctgatgtccaagcgcaaattcgattatctcaccaaggctgagagaggaggcctgacggaagccgacaaagcccggtttatccatcgccagcttgttgagaccagacaaattacaaagaacgtcgctaacatcctgcaccagcggttcaattacgagaaggatgaccatgggaacaccatgaaacaggtgcgcatcgttacactcaagagcgcgctggtgtctcagtttagaaaacaattccagctgtacaaggtccgggatgtgaatgactatcaccacgcccatgatgcttaccttaacggagttgtggccaataccctgctcaaagtctatccccagctggaacctgagttcgtgtacggcgactatcaccagtttgattggttcaaggccaacaaggctacggccaaaaagcaattttacacaaatattatgcttttctttgcgcagaaagaccgcatcattgatgaaaacggggagatcctgtgggacaagaaatatcttgacaccgtgaagaaggtcatgagctacagacagatgaatattgttaaaaagacagaaatccaaaaaggagagttctccaaggctaccatcaaacccaagggcaacagctctaaactgattccgcggaagaccaattgggatcctatgaagtacgggggcctcgactcccccaacatggcctatgccgtggtgatcgagtacgctaaaggaaagaataaactggtctttgaaaagaaaattatccgcgtgacaattatggagagaaaggccttcgaaaaggatgagaaagcgtttctggaggaacagggctatcggcagcctaaggttcttgctaaactgcccaagtacacgctctatgagtgtgaagaggggagacgccggatgctggccagcgccaacgaagctcagaaaggaaatcaacaggtgctccctaaccatctggtcacccttctgcaccatgccgctaactgcgaggtgtccgacggcaagtctctcgattacatcgagagcaatagagaaatgttcgccgagctgctggcgcacgtttccgaatttgccaagcgctatacacttgctgaggccaacctgaataaaatcaaccagctctttgaacagaataaggagggggacattaaagctatcgcccaatctttcgtggatctgatggcctttaacgctatgggagcgcccgccagcttcaagtttttcgagaccacaattgaacggaaaagatacaataacctcaaggagctgcttaattccaccatcatttaccagtctatcacgggcctgtatgaaagccgcaagcggctggacgataaaagaccggctgccacaaagaaagccgggcaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4850 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagaaaccgtacagcattggactggacatcggcaccaactccgttgggtgggcggtggtgacagatgactataaggtccccgctaagaaaatgaaggtgctcggaaatacggataaatctcatattgagaagaacctgcttggcgccctcctgttcgacagcgggaataccgccgaagatcggcgcctgaaaagaacagctcggcgcagatacacccggcgcagaaaccggatcctttatctgcaggagattttctccgaagagatgggaaaggttgacgattctttctttcaccgcctcgaagacagcttcctggtgacagaggataagagaggcgagcggcatcctatctttggcaatctggaagaggaagtcaaataccacgagaacttccccaccatctatcatctccgccaatacctggccgacaatcctgagaaggtggatcttagactggtttatctcgctctggcccacattatcaaatttcgggggcacttccttattgaaggaaagtttgacacacgcaacaatgatgtgcagagactgttccaggagtttctcgcggtctacgacaacaccttcgaaaattcctctctgcaggagcaaaacgtccaggtggaagagatcctgacggacaaaattagcaagtccgccaaaaaggatcgggtgctcaagctgtttcccaatgagaaaagcaacggcagattcgctgaatttcttaagctgatcgttgggaatcaggccgactttaaaaagcatttcgagctcgaagagaaagctcctctgcagttttctaaggatacctacgaagaggagcttgaagtgctgctcgcccaaattggagacaactatgcggagctgttcctgtccgccaagaaactctacgatagcatcctgctttctggcatcctgacagtgaccgacgtcgggacaaaggctccgctctccgccagcatgattcagcgctataacgaacaccagatggatctggctcagcttaaacaatttatccggcagaagctgtctgacaaatacaatgaggtgttctccgatgttagcaaggacggatatgccggctacattgatggcaagaccaaccaggaagccttttataaatacctcaaggggctgctgaataaaatcgagggatccggctacttcctcgacaagattgagagagaagactttctgcgcaaacaacggacgttcgataacgggtctatcccccatcagatccaccttcaggagatgagagctattatccgccggcaggcggaattttatcctttcctggccgacaatcaagatagaattgagaagctcctgacatttcgcatcccctactatgtgggacctctggctcggggcaagagcgacttcgcctggctttccagaaaaagcgccgataagattaccccctggaacttcgacgagatcgtcgataaagaatcttccgctgaggcctttatcaatcgcatgacaaactacgacctctatctgccgaatcagaaggtgctgcctaaacacagcctcctgtacgaaaagttcaccgtttataacgagcttaccaaagtgaagtacaagacagaacaggggaaaacggcgtttttcgatgctaatatgaagcaggagatttttgacggagtcttcaaagtgtaccggaaggtcaccaaagataagctgatggactttctcgagaaggagttcgatgaatttagaatcgtggacctgacaggcctggacaaagaaaacaaggttttcaatgcctcttatggcacctaccatgatctttgcaaaattctcgacaaggattttctggacaacagcaaaaatgagaagatcctggaagatattgtgctcacactgacccttttcgaggaccgggagatgatccgcaagagactggaaaactattccgatctcctgacgaaagagcaagtcaagaaactggaacggagacactacacagggtggggacgcctttctgccgagctcattcatggcatccggaacaaggaaagcagaaaaaccatcctggactatctgattgatgacggaaattccaaccgcaattttatgcagctcatcaacgatgacgctctgagcttcaaggaggagattgccaaggctcaggtgatcggggaaaccgataatcttaaccaggttgtgtctgacattgccggctcccccgcgatcaaaaaggggatcctgcaaagcctcaaaattgtcgacgagctggtgaagatcatgggccaccagcctgaaaatattgtggttgagatggccagagagaaccagttcacaaatcagggacggcgcaactctcaacagagactgaaaggccttaccgattccatcaaggaatttgggagccagattctcaaagagcatcccgtcgaaaattcccaactgcagaacgaccggctgttcctctactatctgcagaatggacgcgatatgtacacaggcgaggaacttgacatcgattacctgtctcagtatgacatcgatcacattatcccccaggcttttattaaggacaacagcatcgataatagagtgctcacgtcctctaaggagaaccgggggaaaagcgacgatgtgccttccaaggacgtcgtgcgcaaaatgaaaagctactggtctaaactgctgtccgccaaacttattacccaaagaaagttcgacaacctgacaaaagctgagcggggaggcctcaccgatgacgataaggccgggtttatcaaacgccagctggttgaaacaagacagatcaccaagcacgtggcgcggattctcgacgagagattcaatacggaaaccgatgagaacaataaaaagatccgccaagtcaagattgtgacactgaaaagcaaccttgtttctaattttcggaaggagttcgaactgtataaagtgagagagatcaacgactaccatcacgcccatgatgcttatctcaatgccgtcattggcaaggctctgctgggagtgtacccgcagcttgaacccgagtttgtttatggcgactaccctcacttccacgggcataaagaaaacaaggccaccgccaagaaatttttctactccaatatcatgaacttctttaagaaagatgacgtgcgcacagataagaatggagagattatctggaaaaaggacgaacacatcagcaacattaagaaagtcctgtcttatccccaggtgaatatcgtgaagaaagtcgaggagcagaccggcgggttcagcaaggaatccattctccctaaaggaaacagcgataagctgatcccccggaaaacgaagaagttttactgggacacaaagaagtatggcgggttcgactctccgattgttgcttactccatcctcgtgatcgcggatattgagaaaggcaagagcaaaaagctgaagaccgtgaaagcccttgtcggagtgacaatcatggaaaagatgacctttgagagagaccctgttgctttcctggagcgcaaaggctatcggaatgtgcaagaagagaacattatcaagctccccaaatactccctgtttaagctggaaaacgggagaaagcgccttctggcctctgcccgggagctccagaaaggaaatgaaattgtcctgcctaaccatctcggcaccctgctttatcacgctaagaatatccataaagtggatgagcccaagcacctggactacgttgataaacacaaggacgagttcaaggaactgctcgatgtggtcagcaacttttccaaaaagtacacactggccgaggggaatcttgaaaagatcaaggagctgtatgcgcagaacaatggagaagacctcaaagagctggcttctagcttcattaacctcctgacgtttaccgccatcggcgcccctgctacattcaagtttttcgataaaaatattgacagaaagcggtacacctccacaaccgagatccttaacgccacgctgattcatcaatctatcacagggctgtatgaaacccgcattgatctcaataagctgggcggagacaaaagacccgcggctaccaagaaagccggccaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4851 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcccagacaacaaacctgagctacattctcggactggaccttggcatcgcgtccgttgggtgggctgtggtggagattaatgaaaacgaggatccgatcggactgattgacgtcggcgtgcggatcttcgaacgcgccgaggttcccaagacgggggaatctctcgccctgagcagacggcttgctcgctccaccagacggctgatccgcagacgggcccatcgcctcctgctggctaaaagatttctcaagcgggaggggattctgtctacaatcgatcttgagaagggcctgcctaatcaagcctgggaactccgcgtggcgggcctggagagacggcttagcgccattgaatggggagctgtcctgctccacctgatcaaacatcgcggatatctgtccaagcggaaaaacgagtctcagaccaataacaaggagctcggcgccctgcttagcggggtggctcagaatcaccagctgctccaatccgacgattacagaacacccgccgaactggcgcttaaaaagttcgccaaggaggaaggacatattagaaaccagcgcggcgcttatacccacacatttaatcggctggacctcctggccgagctgaacctcctgttcgctcagcagcaccaatttgggaatcctcattgcaaagaacacatccagcagtacatgaccgagcttctgatgtggcagaagcccgccctcagcggagaggccattctgaaaatgcttggcaagtgtacgcatgaaaagaacgagttcaaagctgcgaaacacacctattctgccgaaagatttgtttggctgacaaagctcaataacctgcgcatcctggaggatggcgctgaacgggccctcaatgaggaggaaagacaactgcttatcaaccacccttacgagaagtccaaactgacctatgcccaggtgcgcaagctcctggggctgagcgaacaggctattttcaaacatcttcggtactctaaggagaacgccgaatccgcgacatttatggagctcaaggcttggcacgccatcagaaaagccctggagaatcaaggactgaaggacacctggcaggatctcgctaaaaagccggacctgcttgatgaaattggcacggccttcagcctgtacaaaacagacgaggatatccagcagtatctcaccaacaaggtccccaattctgtgattaacgctctgctggtgtcccttaattttgacaaattcatcgaactcagcctgaagtccctgcgcaagatcctccctctgatggagcaagggaaacggtacgaccaggcctgcagagagatttatggacatcactacggcgaagcgaaccagaagacatctcagcttctgcccgccatccctgctcaagagattcgcaatcccgtcgttctccggaccctgagccaggccagaaaagtgatcaacgctattatccggcagtatgggtccccggcccgcgtgcatatcgaaaccggaagagagctgggcaagagctttaaagaacggagagagattcagaagcaacaggaggataatcgcacaaagcgggaatctgcggtccagaaattcaaggagcttttctccgactttagctctgaacctaaaagcaaggatatcctcaaattcagactgtacgagcagcaacacggcaagtgtctgtattccgggaaagaaattaacatccaccgcctcaatgagaagggatacgtggagattgaccatgccctgcccttttctagaacgtgggatgacagcttcaacaataaggttcttgtgctggcttccgaaaaccagaataaaggcaaccagaccccttacgagtggctccaagggaagatcaacagcgaacggtggaaaaattttgtcgccctggtgctgggatctcagtgctccgctgccaagaaacagcgccttctcacacaggttattgatgacaacaagttcatcgatagaaatctgaacgacacccggtatatcgcccgctttctgagcaattacattcaagagaacctcctgcttgtgggcaagaataaaaagaacgtcttcacacccaatgggcagatcaccgctctgctcagatctcggtggggcctgattaaagcgcgcgaaaacaataacagacaccatgccctggatgctatcgtggtcgcctgtgccacgccctccatgcagcagaagattacacggtttatccgcttcaaagaggtgcacccttataagatcgagaatagatacgaaatggttgaccaagagagcggagaaattatctccccgcactttcccgagccttgggcttatttccggcaggaggtgaacattagagtctttgacaatcatcccgataccgtgcttaaggaaatgctgcctgaccgcccccaggccaaccaccagttcgttcaacctctcttcgtgtctcgggcgccgaccagaaaaatgagcggccaggggcatatggagacaatcaagtccgctaaacgcctggccgaaggaatttctgtcctccggatccccctgacccagcttaagcctaacctgctcgagaatatggtgaacaaagaaagagagcccgccctgtacgctggcctgaaggcccgccttgcggagtttaatcaagatcctgctaaggccttcgccacacccttttataaacaagggggacaacaggtgaaggctatccgggttgaacaggtccagaaaagcggcgtgctggtgagagagaacaatggggtcgccgacaacgcttccattgtgcgcacggatgttttcatcaagaataacaaatttttcctcgtgccgatttacacctggcaggtcgccaagggcatcctgcctaataaagcgattgtggcccacaagaacgaagacgagtgggaagagatggatgagggagctaagtttaaattcagcctctttcccaatgacctggttgaacttaagaccaaaaaggagtacttctttggctattacatcgggctggatcgggccacaggaaacatctctctcaaagaacatgacggcgagatttccaaggggaaggatggagtgtatagagtcggcgtgaaactggctctgagcttcgaaaagtaccaggttgacgagcttgggaaaaatcggcagatctgccgcccccagcagagacagcctgtgcggaagcgcccggccgccaccaaaaaggctggccaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4852 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcggctttcaagccgaaccccattaattacatcctgggactcgacattggcatcgccagcgttgggtgggccatggtggagattgatgaagacgagaaccctatctgcctgatcgatcttggagtgcgggtctttgaacgcgctgaggtgcccaaaaccggcgactccctggccatggctagacggctcgcccgctctgttagacggctgacacgcagacgggcgcatcgccttctgagagcccggcgcctcctgaagagagaaggggtgctgcaggctgccgatttcgacgagaatggactcattaagagcctgcctaacacgccctggcaacttcgggctgccgcgctggatcgcaaactcacccctctggagtggtccgccgtccttctgcacctcatcaagcatagaggctatctgtctcagcggaaaaatgaaggcgagacagctgacaaggaactgggggccctcctgaaaggagtggctgataacgcccacgcccttcagaccggcgactttagaacaccggctgagctggcgctcaataagttcgagaaggaaagcgggcatattcgcaaccagcggggagattactcccacaccttttctagaaaagacctgcaagccgagcttatcctcctgttcgaaaagcagaaagagtttggcaatccccacgttagcgggggactgaaggaaggcattgagacactgctcatgacccagcgccctgctctgtccggcgatgccgtgcagaaaatgcttgggcattgtacgttcgagcccgccgaacctaaggctgccaaaaacacctatacagcggagcggtttatctggctgaccaagctcaataacctgcgcattcttgaacaaggaagcgagagacccctgacagacaccgaacgggctacgctcatggacgagccgtacagaaagtctaaactgacatatgcccaggcccgcaagctgctcggcctggaggataccgctttctttaaagggcttcggtacggaaaggacaatgccgaggcttccacactgatggaaatgaaagcctatcacgcgatcagcagagccctcgaaaaggagggcctgaaggataaaaagtctcctctgaacctttcccccgaactccaggacgagatcgggaccgctttcagcctgtttaaaaccgatgaggacattacaggacgcctgaaggatcggatccagcctgaaattctcgaggccctgcttaaacatatctctttcgacaagttcgtccaaatttccctgaaggctctcagacggatcgtgcccctgatggaacagggcaaacgctacgatgaggcctgcgcggagatctacggcgaccactatgggaagaaaaatacggaagagaagatttacctgccccctatcccggccgatgaaattagaaaccccgtggtccttcgggctctcagccaggccagaaaagttatcaacggagtggtgcgccggtatggctcccctgctcgcattcacatcgagaccgccagagaagtcgggaagtcttttaaggacagaaaagagatcgagaagcggcaagaagagaatcgcaaagacagagaaaaggccgctgcgaaattccgggagtactttcccaacttcgtgggagaacctaagagcaaagatattctgaagctgcgcctctatgagcagcagcatggcaagtgtctgtactccgggaaagagatcaatcttggcagactgaacgaaaagggatatgttgagattgaccacgccctcccctttagccggacatgggatgactctttcaataacaaagtgctggtcctgggctccgaaaatcagaacaaggggaatcaaaccccgtacgagtactttaacggaaaagataatagccgcgaatggcaggagttcaaggctagagtggagacatctcggtttcctcgcagcaagaaacagagaatccttctccagaagttcgacgaagatggctttaaagagcggaacctgaatgacaccagatatgttaaccgcttcctgtgccaatttgtggccgatcggatgagactcacggggaagggcaaaaagcgcgtcttcgcctccaatggacagattacaaacctgcttcgggggttctggggcctgagaaaggtgcgcgctgaaaacgaccggcatcacgccctcgatgcggtcgtggttgcttgttctaccgtggccatgcagcagaaaatcaccagatttgtccgctacaaggagatgaatgccttcgacggaaaaacaattgataaggagaccggcgaagtgctgcatcagaaaacacactttccccagccttgggagttctttgctcaggaagttatgatccgggtgttcgggaagcccgacggaaagcctgagtttgaagaggccgacacgcccgagaaactgagaacccttctcgcggaaaagctgagctcccggccggaggctgtccacgaatatgtgacacctctgttcgtgagccgcgcccccaacagaaaaatgtctggccaggggcatatggagaccgttaagtccgccaaacggctcgatgaaggagtcagcgtgctgcgcgtgccccttacacaactgaagctcaaagacctggagaagatggtcaatagagagcgggaacctaagctgtacgaggctcttaaagccagactggaagctcacaaggatgacccggccaaagcgtttgccgagcccttctataagtacgataaagctggcaaccgcacccaacaggtgaaggccgttcgggtggaacaagtccagaagacgggggtgtgggttagaaatcataacggcatcgctgacaatgccaccatggtgcgcgtcgatgtgtttgagaaaggagacaagtattacctcgttcctatttactcttggcaagtggccaaaggcatcctgcccgatcgggctgtcgtgcaggggaaggacgaggaagattggcagctcattgacgattccttcaactttaaattcagcctgcaccctaatgaccttgtggaggtcatcacaaagaaggcgagaatgttcggatattttgcctcctgccaccgcggcaccgggaacattaatatccggatccatgacctggatcacaaaattggaaagaacggcatcctcgaagggattggcgttaaaacagctctgtctttccagaagtaccagatcgacgagctgggaaaagagattagaccctgtcgccttaagaagagacctcccgtgcggaaacgcccggccgccaccaagaaagctggccaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4853 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccaagtaccatgttggaattgacgtgggcaccttcagcgtggggctggcggctatcgaggtcgatgacgccggaatgccgattaaaacactctccctggtgtctcacatccatgatagcggccttgaccccgatgaaattaagtccgccgttacgcggctggcttctagcgggatcgcccgcagaacccggcgcctctatagacggaagcgcagacggctgcagcaacttgacaaatttatccagcgccagggatggcctgtgattgagctggaagattactccgaccccctctatccttggaaggtcagagctgagctggccgcgtcttacatcgccgatgaaaaagagcggggcgagaagctgagcgtggctctccgccacattgccagacatcggggctggcgcaacccctatgctaaagtttccagcctgtaccttcctgacgggccgtctgatgccttcaaggcgatcagagaagagattaagcgggcctccggacagcccgtgcctgaaacagctaccgtcggccaaatggtgacactgtgcgagctcgggaccctgaaacttagaggagagggcggggtgctgagcgcccgcctccagcagtctgactatgctcgggaaatccaggagatttgtagaatgcaagaaatcggacaggagctgtaccgcaagatcattgatgtcgtttttgccgccgaatcccccaaaggcagcgcttcttcccgggtgggcaaggaccctctgcagcccgggaaaaatagagcgctcaaggccagcgacgctttccagcgctaccggatcgccgccctgattggaaaccttagagtgcgcgtcgatggcgagaaacggatcctgtccgtggaggaaaagaatctcgtttttgaccacctggtgaaccttacaccgaagaaagagcctgaatgggtcaccattgctgagatcctggggatcgatagaggacaactcattggcacggccaccatgacagacgatggggaacgcgcgggagctcggccccctacccacgacacaaatagatctatcgtgaacagccggattgctcccctggttgattggtggaagaccgcctccgccctggagcagcatgccatggtgaaagctctcagcaatgccgaggtcgacgatttcgactctcccgaaggcgcgaaggtgcaggcctttttcgctgatctggacgacgatgtccacgccaaacttgactccctgcatctccctgtgggccgcgctgcctatagcgaggatacgctggttagacttacacggagaatgctgtctgacggggtggatctctacaccgcgcgcctgcaagaatttggaatcgagccgagctggacaccccctacaccccggattggcgaacctgtcgggaaccccgccgtggacagagttctgaagaccgtgtcccgctggctcgagtctgctaccaagacgtggggagccccggagagagtcatcatcgaacacgtgcgggagggcttcgtgaccgaaaaacgcgctagagagatggatggggacatgcggcgcagagccgcccggaatgctaagctgtttcaggagatgcaggaaaaacttaacgttcagggcaagcctagccgcgcggatctgtggagatatcaatccgtccagcggcagaattgccagtgtgcctactgcggaagccccattacattctctaactccgagatggaccacatcgtgcctcgcgctggccaagggagcaccaatacaagagaaaacctcgtggccgtctgtcatcggtgcaatcagtctaaaggaaacaccccctttgccatttgggctaagaacacgtccatcgagggcgtgagcgttaaggaagccgtggagagaacacgccactgggtcaccgataccgggatgcggtccacagacttcaaaaagttcaccaaagcggtggttgagagatttcagcgcgctacaatggatgaagagattgacgcccggtctatggaaagcgtggcctggatggctaatgagctgagatcccgcgtcgcccagcatttcgcgtctcacggaacgaccgtgcgggtttatagaggcagcctgacagctgaagcccgccgggcctccgggatcagcggcaagctgaaatttttcgacggagtgggcaagtctagactcgatcggcgccatcacgctattgacgccgctgtcatcgcctttacctccgattacgtggcggagacactggccgtgagaagcaacctgaagcaatctcaggctcaccggcaggaggcccctcagtggcgcgaatttaccgggaaagacgctgagcatagagccgcctggcgggtctggtgtcaaaagatggaaaaactctccgctctgcttacggaggatctgagagacgatcgcgttgtggtgatgagcaatgtccggctcagactgggaaacggctctgcgcacaaggaaaccatcgggaaactgagcaaggtgaaactttccagccagctctctgtttccgacattgataaggccagctccgaggctctgtggtgcgccctgacacgcgagcccggatttgacccgaaggaaggcctccctgccaatcccgagcggcatatcagagtgaacgggacccacgtctatgctggcgataatattggactgttccccgtgtctgccggcagcatcgcgcttcgcgggggatacgctgaactgggctcctcttttcaccatgcccgggtttacaaaattacaagcgggaagaaacctgccttcgctatgctcagagtgtataccatcgacctgctgccgtaccgcaaccaggatcttttctccgtcgagctcaagccccaaacgatgtctatgagacaggccgagaaaaagctgcgggacgcgctggctacaggaaatgccgaatatctcggctggctggtggttgacgatgagcttgtggtcgacaccagcaagatcgccacagatcaggtgaaagctgtggaagccgagctggggaccattcgcagatggcgggtcgacggcttcttttcccctagcaagctccgcctgagacccctgcagatgtctaaagaaggaatcaagaaagagtccgctcctgagcttagcaagattatcgatcggcccggctggctccctgccgttaacaagctgttctctgacgggaatgtgaccgtggtcagacgcgattccctgggacgggtgagactcgaaagcacagcgcaccttcccgttacgtggaaagtgcaaaagcgcccggccgctaccaaaaaggccggccaggctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4854 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccgcgcggattctggctttcgacatcggaattagctccatcggctgggccttttctgagaacgatgaactcaaggactgcggggttcgcattttcaccaaagtggagaatccgaagacaggagaaagcctggcccttcccagacggctggctcgctccgccagaaagcggctcgctcgcagaaaagcccggctgaaccatcttaagcacctgatcgcgaatgagtttaaactcaactacgaagattatcagtctttcgacgagagcctggccaaggcttacaaaggctccctgatctctccttatgagctccgctttagagccctgaatgaacttctgagcaagcaagatttcgctcgggtgattctccatatcgccaagcgcagagggtacgacgatattaaaaactccgacgataaggagaaaggagcgatcctgaaggccattaaacagaatgaagagaaacttgctaactatcagagcgtcggcgagtacctgtataaagaatactttcagaagttcaaggaaaattctaaagaatttacgaacgtgcggaataagaaagagtcctacgaacgctgtatcgcccagagcttcctcaaggacgagctgaaactgatttttaagaagcaaagagagttcggcttttctttctccaaaaagttcgaagaggaagttctcagcgtggctttttataaacgggccctgaaggatttctctcaccttgtcgggaactgctcctttttcaccgacgagaaaagagcccccaagaatagccctctggcttttatgttcgtggcgctcacacgcatcatcaacctgcttaataacctgaagaacaccgaaggcattctctacacaaaagatgacctgaatgccctgctcaacgaggttctgaagaatggaacccttacatataaacagaccaagaaactgctcgggctgtccgacgattacgagtttaagggagaaaagggcacgtatttcatcgagtttaaaaagtacaaagagttcattaaggctcttggggagcataacctgtctcaggacgatctcaatgaaatcgccaaagacattaccctgatcaaggatgagatcaaactgaagaaggccctcgctaaatatgacctgaaccaaaatcagattgatagcctttccaagctggagtttaaagaccacctcaacatcagcttcaaggccctgaaactggtgacaccccttatgctcgaaggaaagaagtacgatgaggcgtgtaatgaactgaacctgaaagtcgctattaatgaggacaagaaagattttctccctgccttcaacgagacctactataaggacgaagtgacaaatccggtggtcctgcgggccatcaaagagtacagaaaggttcttaacgctctgctcaagaaatatggcaaggtgcacaaaattaatatcgaactggcccgcgaggtgggcaagaaccattctcagcgggctaaaatcgaaaaggagcagaacgagaattacaaggccaaaaaggacgcggaactggagtgcgaaaaacttgggctcaagattaactccaaaaatatcctgaagctgagactcttcaaagagcaaaaggaattttgtgcctatagcggagagaagattaaaatctctgatctgcaggacgagaagatgcttgaaattgatcacatctacccctatagccgctccttcgacgattcttacatgaacaaagtcctggtgtttaccaagcagaatcaagagaaactcaaccagacgcctttcgaggcttttggcaatgacagcgccaagtggcagaagattgaagttctggctaaaaacctgcccacaaagaaacagaagcggatccttgataaaaattacaaggacaaggaacaaaagaacttcaaggatagaaatctcaacgacacccgctatatcgcccggctggtgctgaattacacaaaagattatctcgactttctgcctctttccgatgacgagaacaccaagctgaatgacacccagaaagggagcaaggtccatgtggaggcgaagtctggaatgctcacatccgccctgagacacacgtggggcttcagcgctaaagatcgcaacaaccatctgcaccacgccattgacgctgttatcattgcctacgccaataactctatcgtgaaggctttttccgatttcaaaaaggaacaggagagcaattccgcggaactttatgccaaaaagatttctgagctcgactacaagaacaaacggaagtttttcgagccctttagcgggttcagacagaaagtcctggataagatcgacgaaatcttcgtgtccaaaccggagcggaagaaaccttctggagctctgcatgaagagacctttcgcaaggaagaggagttctatcaaagctacggcggcaaggaaggggtcctcaaagccctggagcttggaaagattagaaaagtgaatggcaagatcgttaaaaacggggatatgtttcgggtggacattttcaagcacaagaaaacaaataagttttacgccgtccccatctataccatggatttcgctctgaaagtgctccctaacaaggccgttgcgagatccaaaaagggagaaattaaggactggatcctgatggatgagaattacgaattttgcttcagcctgtataaagactctcttatcctgattcagacaaaggatatgcaggagcccgagtttgtgtactataacgctttcacctccagcacggtctctctcatcgtgtccaaacatgacaataagtttgaaacactgagcaaaaaccagaagattctcttcaagaatgccaacgagaaagaagtgatcgccaagtctattggcatccaaaatctgaaagttttcgagaagtacatcgtcagcgctcttggggaagtgaccaaagccgagtttcgccagcgggaggacttcaagaaaaagagacccgcggctaccaagaaagccggccaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4855 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcgacctggttctcggactggatattggcatcgggtccgtgggagtgggcattcttaacaaggtcaccggggagatcattcataaaaattctcggatcttcccggcggctcaggccgaaaacaatctggtgcgcagaacaaaccggcaaggacgcagactcgcccggcgcaagaagcacagacgggttcgcctgaatagactttttgaggaaagcggcctgatcacggacttcaccaaaatttccatcaacctcaatccctaccagctgcgggtgaagggcctgacagatgagctctctaacgaggagctgtttattgctcttaaaaatatggtcaagcatcgcgggatcagctatctggacgatgcctccgacgatggaaactctagcgtgggcgactacgctcagattgttaaagaaaattccaagcagctcgaaaccaagacacctgggcaaatccagctggagagatatcagacctacggacagcttcggggcgatttcacagtggaaaaagacgggaagaaacaccgcctgattaacgtctttcccaccagcgcctatagatctgaggcgctccggatcctgcaaacgcagcaggagttcaatcctcagatcaccgatgaatttattaacagatacctggagatcctcacaggaaagcgcaaatattaccatggccccggcaatgaaaagtcccggaccgactacgggagatatcgcacaagcggagagaccctggataacattttcggcatccttattgggaaatgcacgttttaccctgacgagttccgggccgctaaggcctcttatacagctcaagaatttaacctgctcaatgacctgaacaatcttaccgtgccgacagagaccaagaaactgtccaaggaacagaaaaaccagatcatcaattacgtgaagaacgagaaagccatgggacccgcgaaactcttcaagtatattgccaaactgctgagctgtgatgtcgctgacatcaagggctacagaattgataaatctgggaaggccgaaatccacacctttgaggcttatcgcaaaatgaagacactcgaaacgctggacattgagcaaatggatcgggagacccttgacaagctggcctacgttctcacactgaataccgaaagagagggaatccaggaagcccttgagcacgagttcgctgatggctccttcagccagaaacaggtggacgaactggtgcaatttcgcaaggcgaactcctctatcttcggcaaagggtggcataattttagcgtcaagctcatgatggagctgattcctgaactgtacgagacatccgaggaacagatgaccatcctcacgcggctgggaaaacagaagacaacctcttcttccaacaagaccaaatatattgatgagaaacttctgacagaagagatctacaatcccgtggttgccaagagcgtgagacaggctattaagatcgtcaacgccgccattaaagaatatggcgacttcgataatatcgtgatcgagatggctcgcgaaaccaacgaggacgacgagaagaaagccattcaaaagatccagaaggcgaataaagatgaaaaggacgctgccatgctcaaagccgctaaccagtacaacgggaaggccgagctgcctcactctgtttttcatggacacaaacagctggctacaaagattcggctttggcaccaacagggcgaaagatgcctctatacggggaagaccatcagcattcatgatctgatcaataactccaatcagttcgaggtggaccacatcctgcccctctctattacatttgatgacagcctggccaacaaagtccttgtgtacgcgaccgccaatcaggaaaagggccaacggacaccgtatcaggctctggattccatggacgatgcctggagcttccgcgagctcaaggcttttgtcagagagtctaagaccctgtccaacaaaaagaaggaatacctgcttacggaggaagacatcagcaaattcgatgtgcggaagaaatttattgagagaaatctcgttgacacccgctacgcctctcgggtggtcctgaacgcgctgcaggaacatttcagagcccacaagatcgatacaaaagtgtccgttgtgcgcggacaatttaccagccagctcagacggcattggggcattgagaagacacgcgacacctatcaccaccatgctgtcgacgccctgatcatcgctgcctcctctcagcttaatctgtggaagaaacagaagaacacgctcgtgagctactccgaggatcaactgctggacattgaaacaggggagcttatctctgatgacgaatataaagagagcgtgttcaaggccccttaccagcacttcgttgataccctcaaatccaaggagtttgaagacagcattctgttctcttatcaggtcgattccaaatttaatagaaagatcagcgacgctacaatttacgcgacccggcaggccaaggtgggaaaagataaggctgacgagacctatgtgctgggcaaaatcaaggatatctacacacaagacgggtacgatgccttcatgaaaatttataagaaggacaaatctaagtttctcatgtaccgccatgacccccagacgttcgaaaaagtcatcgagcctattctggaaaactatcccaataagcagatcaacgagaaaggaaaggaggtgccctgtaatccttttcttaagtacaaagaggaacacggctatattagaaagtactccaaaaaggggaacggcccggaaatcaaaagcctgaagtattacgattctaagctcggaaaccacattgacatcacccccaaagatagcaataacaaggttgtgctgcagtccgtcagcccttggcgggccgacgtgtacttcaataaaacaaccggcaagtatgagatcctggggcttaaatacgctgatctccaatttgaaaagggaacaggcacctataagatttctcaggagaaatacaacgacatcaagaaaaaggagggggttgattccgacagcgagttcaaatttacgctgtataagaatgatctgctcctggtgaaagacacagaaaccaaggaacagcaacttttccgctttctgtccagaaccatgcccaagcagaaacattacgtcgagctcaagccttatgataaacagaagttcgaaggaggcgaggccctgattaaagtgctggggaacgttgcgaatagcggccagtgcaagaagggacttggcaaaagcaacatctccatttacaaggtgcggacagacgtcctggggaatcaacacatcatcaaaaacgagggagacaagcccaaactcgatttcaagcgcccggctgccaccaagaaagccggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4856 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccacccagttcgagggatttacaaacctgtaccaagttagcaagacgctccggttcgaactgattccgcagggcaaaacccttaagcatatccaggagcaggggtttattgaagaggacaaggcgcgcaatgatcactataaagaactgaagcccatcattgacagaatctacaaaacatatgctgatcaatgcctccagctggtgcagcttgactgggagaacctgtccgccgccatcgattcttaccggaaggagaaaaccgaagagacacgcaatgctctcattgaagaacaggccacctatagaaacgctatccatgactacttcattggacggacagataatctgaccgacgccatcaacaagcgccacgcggagatttataagggcctgtttaaagccgaactcttcaatgggaaggtgctgaaacaacttggaacggtcaccacaaccgagcatgaaaacgctctgctcagatcctttgataagttcacaacctactttagcggcttctacgagaatcggaaaaacgtgttttctgccgaagacatcagcacggctattcctcaccgcatcgttcaggataatttccccaagtttaaagagaactgtcacatcttcacaagactgattaccgccgtgccttcccttcgggagcatttcgaaaatgtcaagaaggcgatcggcatttttgtgtctacaagcatcgaggaagttttctcctttcccttctataaccagctgctcacccagacccaaattgacctgtacaatcagctgctcgggggaatcagccgcgaggccggcacagagaaaatcaaggggctgaacgaggtgcttaacctggctattcagaaaaatgatgagacggcccacatcattgcttctctccctcatagatttatcccgctgttcaagcaaattctttccgaccggaacaccctgagctttatcctcgaagagttcaaatctgacgaagaggtcatccagtccttttgcaagtataagacactgctgcgcaatgaaaacgtgctcgagaccgccgaggccctgttcaatgaacttaacagcattgatctgacacacatctttatttctcacaaaaagctcgagaccatctccagcgctctgtgtgaccattgggatacgcttagaaatgcgctgtacgaacggagaatttccgagctcacaggaaaaatcaccaagtctgccaaagagaaggtgcagcgcagcctgaagcacgaagacattaacctgcaggagatcatctccgctgccggcaaagaactcagcgaggccttcaagcagaaaacctctgaaattctgtcccatgctcacgccgcgcttgatcaacccctgcctacaaccctcaagaaacaggaggagaaggaaatccttaagagccagctggactctcttctcgggctgtatcatctgctcgattggtttgctgtcgacgagagcaatgaagttgatcccgagttctccgcccggctgacaggaattaaacttgaaatggagccttctctgagcttctacaacaaggccagaaattatgctacgaaaaagccctactccgtggagaaatttaagctcaacttccaaatgccgaccctggccagcggctgggacgtgaataaagaaaagaacaatggcgctatcctgtttgtcaagaacgggctttactatctcggaattatgcctaaacagaagggccgctacaaagccctgtctttcgagcccacagaaaagacctccgaggggtttgataaaatgtattacgactatttccctgacgcggccaagatgatccccaagtgcagcacacagctgaaagctgtgaccgcccactttcagacgcacaccacacccatcctcctgtctaacaatttcattgaacctcttgagatcaccaaggagatttacgatctgaacaatccggaaaaagagcccaagaaatttcaaacagcttatgccaagaagaccggagaccagaaaggctaccgggaagcgctctgtaagtggatcgatttcacgagagactttctgtccaaatacacaaagaccacaagcattgatctgtcctctcttcgccctagctcccagtataaagacctcggggagtactatgccgagctgaaccccctgctctaccatatctctttccagcggatcgctgaaaaggagattatggatgccgttgaaaccggaaagctgtatctttttcaaatctacaataaagacttcgctaagggccaccatggcaaacctaacctgcacaccctctattggacagggctgttcagccccgagaatctggccaagacgtccattaaacttaacggacaggccgaactcttttacagacctaagagccgcatgaaacggatggctcacagactgggcgagaagatgctgaataagaaactcaaggatcagaaaaccccgatccccgacacactgtaccaagagctttatgattacgtgaaccatcgcctgtctcacgacctctccgatgaagcgcgggccctgctgcctaatgtcattaccaaggaggtgagccatgaaatcatcaaagacagacggttcacatctgacaagtttttctttcacgttcccattacccttaactatcaggctgccaattcccctagcaagttcaaccagcgcgtgaatgcctacctgaaagagcatcccgaaacgccgatcattgggatcgatagaggagagcggaacctcatttatatcacagtcattgactctaccggcaagatcctggagcagagaagcctcaacaccatccaacagtttgattaccagaaaaagctggacaatcgcgaaaaagagcgggtggctgccagacaggcgtggtccgtcgtggggacaattaaggatcttaagcaaggctatctgagccaggttatccacgaaattgtggacctcatgatccactaccaggctgtcgtggttctggagaacctgaatttcggatttaaatctaagcgcaccggcattgccgaaaaagccgtgtaccagcaattcgagaagatgcttatcgataaactgaactgcctcgtcctgaaggactatcctgctgagaaggttgggggagtgctcaatccctaccagctgacagatcagtttacgtccttcgccaaaatgggcacccaaagcgggttcctgttttatgtgcccgcgccttacacatccaagatcgacccgctgaccggattcgtcgatccctttgtgtggaaaacaattaagaaccatgaatctagaaaacacttcctcgagggctttgacttcctgcattatgatgtgaagaccggggactttatcctgcacttcaagatgaatcggaaccttagctttcagcgcggcctgcctggattcatgcccgcttgggacattgtctttgagaaaaatgaaacgcagttcgatgccaagggcaccccttttatcgccgggaaaagaattgtgcccgttatcgagaaccatcggttcacaggacgctacagagacctctatcctgctaatgaactgatcgccctcctggaggaaaagggcattgtgttccgggatgggtccaacatccttcccaaactgctggagaatgacgattctcacgctattgacaccatggtcgccctcatccgcagcgtgctgcagatgagaaactccaatgcggccacaggagaagattacattaactctccggttcgggaccttaacggcgtgtgttttgatagccgcttccaaaatcctgagtggcccatggacgctgatgccaacggggcttaccacatcgccctgaagggccagctcctgctcaatcatctgaaagagtccaaggaccttaagctgcagaacggaattagcaatcaggactggctggcctatatccaagaactcagaaacaaacggcctgctgcgaccaagaaagccggccaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4857 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgccagcatttaccaggagttcgttaacaagtattccctgtctaaaaccctccggtttgaactgatcccgcaaggaaagacacttgagaatattaaggcgcgcggcctgatcctcgacgatgaaaagagagctaaggactacaaaaaggccaaacagattatcgataagtatcatcagttctttatcgaggaaattctgagctccgtgtgcatctctgaggaccttctgcagaactacagcgatgtgtatttcaagctcaaaaagtccgacgatgacaatctgcaaaaagattttaagtctgccaaagacacgattaagaaacagatcagcgagtacattaaggattccgaaaagttcaaaaacctgtttaatcagaacctcatcgacgctaagaaagggcaggagagcgatctgattctttggctgaagcaatctaaagacaatggaatcgaactcttcaaggccaactccgacatcaccgatattgacgaggctctggagatcattaagagctttaaaggctggacaacctatttcaaggggtttcacgaaaatcggaaaaacgtctactcttccaatgatatccccacaagcattatctaccgcatcgtggacgataaccttcctaagttcctggagaataaagccaagtatgaatctctcaaggacaaagcgcccgaggccattaactacgaacagatcaagaaagatctggctgaggagctgacctttgacattgattataagacatccgaagttaatcagagagtgttcagcctcgacgaggtcttcgaaatcgccaactttaacaattacctgaaccagtccggaattaccaaattcaatacgatcatcggcggcaagtttgtgaacggggagaataccaagcggaaaggaattaacgaatatatcaatctttactctcaacagattaacgataagacactgaaaaagtataaaatgagcgttctcttcaagcagatcctgtccgacaccgagagcaaatcttttgtgattgacaaacttgaggatgactccgatgtcgtgacaaccatgcagagcttctacgaacaaatcgctgcctttaagacggtggaggaaaaatctattaaggagacactgagcctcctgttcgacgatctgaaagcgcagaagctcgacctgtccaaaatctactttaagaatgataagtctcttaccgacctgagccagcaagtcttcgatgactattccgttatcggcacagccgtgctcgaatacattacccagcagatcgctcctaaaaacctggataatcccagcaagaaagagcaggagcttattgccaagaaaaccgaaaaggctaagtatctgtctctcgagacaatcaaactggccctggaagagtttaacaagcatcgcgacattgataaacaatgtagattcgaggaaatcctcgccaattttgctgcgatccctatgattttcgacgagatcgcccagaacaaggacaatctggctcagatttccatcaaataccagaaccaagggaagaaggatcttctgcaggccagcgccgaagacgatgtgaaagctattaaggacctcctggatcagacgaacaatctgcttcacaaactcaagatcttccatatctctcagtccgaggacaaagccaacattctggataaggacgaacacttttatctggtcttcgaggagtgctactttgaactcgcgaatatcgtgccgctgtataacaaaattcggaattacatcacccaaaagccctacagcgatgagaagttcaaacttaactttgaaaattccacactggctaacggatgggacaagaataaagagcctgataacaccgccattctcttcatcaaggacgataaatattacctgggcgttatgaataagaagaacaataaaatctttgacgacaaggccattaaagaaaacaagggggagggatataaaaagatcgtgtacaagctgcttcccggcgctaataaaatgctccctaaggtcttcttttctgccaaaagcattaagttctataacccctccgaggatatcctgcgcattagaaaccactctacacataccaaaaatggcagcccgcagaaggggtacgaaaagtttgagttcaacatcgaagactgtcggaaatttattgatttctataagcagtccatcagcaaacaccctgagtggaaggacttcggatttcgcttctctgatacgcaaagatacaattccatcgacgaattttaccgggaggtggagaaccagggctataaactgacattcgaaaatattagcgagtcttacatcgattccgttgtgaaccaggggaagctctatctgtttcagatttacaataaggacttcagcgcttattctaaaggacgccccaaccttcataccctgtactggaaggccctctttgatgaaagaaatctgcaagacgtcgtgtataaactgaacggcgaggcggagcttttctaccggaagcagagcatccctaaaaagattacccaccccgccaaagaagctatcgccaataagaacaaggataatcccaaaaaggagtccgtctttgaatacgacctcatcaaagacaagagattcacagaggataaatttttcttccactgccctattaccatcaactttaagagctctggggctaataagttcaacgacgaaattaacctgctgctcaaagagaaggccaatgatgtgcatatcctgtccattgaccgcggagagcggcaccttgcgtattacacactggttgatggcaaaggcaacatcatcaagcaggacacgtttaatattatcgggaacgatagaatgaaaaccaattatcatgacaagctcgccgctattgaaaaggatcgcgacagcgcccggaaagattggaagaaaatcaacaatattaaggagatgaaagaaggatacctgtcccaggtggtccacgagatcgctaagctggtgattgaatataacgccatcgttgtgttcgaggaccttaattttggcttcaagagagggcgctttaaagtcgagaagcaagtgtaccagaaactcgaaaagatgctgatcgagaaactgaactatctcgtgttcaaggataatgaatttgacaaaacaggaggcgttctgcgggcctaccagcttaccgctccgttcgagacatttaagaagatggggaaacagaccggcattatctactatgtccccgcgggattcacgtctaagatttgtcctgtgaccggctttgtgaaccaactgtaccccaaatatgaaagcgtctccaagtctcaggagttcttcagcaaatttgacaagatctgctacaatctcgataaggggtatttcgagttttccttcgactacaaaaactttggagataaggccgctaaaggcaagtggacaattgcctctttcgggagcagactgatcaattttcgcaactccgacaaaaatcataactgggatacccgggaagtgtatcctacaaaggagctggaaaaacttctgaaagactacagcatcgagtacggacacggcgagtgtattaaggccgctatctgcggggaatctgataaaaagttctttgccaaactcacctccgttctgaacacgattctccagatgagaaatagcaagacaggcaccgagctggactatcttatctctcccgtggcggatgtcaacggaaatttctttgactcccgccaagctccgaagaacatgcctcaggatgccgacgccaatggcgcttaccacattgggctgaaaggactcatgctgctgggccggatcaagaacaatcaggaagggaaaaagctgaaccttgtgatcaaaaatgaggaatatttcgagtttgttcagaacagaaataacaagcggcccgccgcgacaaagaaggctggacaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 4858 - RNA, 51 nt, synthetic construct
  misc_feature 1..51: note = NLS2 variant
  source 1..51: mol_type = other RNA
atggcaccaaaaaaaaaaagaaaagtaggaatacacggagtaccagcagca

SEQ ID NO: 4859 - RNA, 48 nt, synthetic construct
  misc_feature 1..48: note = NLS4 variant
  source 1..48: mol_type = other RNA
aaaagaccagcagcaacaaaaaaagcaggacaagcaaaaaaaaaaaaa

SEQ ID NO: 4860 - RNA, 4107 nt, synthetic construct
  misc_feature 1..4107: note = Cas9 variant
  source 1..4107: mol_type = other RNA
atggataagaaatatagtataggccttgatataggcaccaatagcgtaggatgggccgtaataacagatgaatataaagttccaagcaagaaatttaaagtattaggaaacacagatcgacattcaattaagaaaaacctaattggagcactacttttcgacagtggagaaacagcagaagcaactcgtctaaaaagaaccgcaagacgaagatatactcgaagaaagaacagaatttgctacctacaagaaatattttctaacgaaatggctaaagtagacgactcatttttccacagactagaagaatcctttctggttgaagaagataagaaacatgaacgacatccgattttcggaaatatagtcgatgaagtggcataccacgaaaaatacccaaccatctaccaccttcgaaagaaattagtggacagcacagacaaagcagacttaaggttaatatatctagctttggcacacatgatcaaattccgaggacattttctaattgagggagatctaaaccccgacaactctgatgtcgacaaactatttatacaattagtacaaacttacaatcaactatttgaggaaaacccaatcaacgcctcaggtgtcgacgcaaaagccattctatcagcaagattatcaaaaagccgaagactagaaaacttgatcgcacaactcccaggagagaagaaaaatggactcttcggaaatcttatagcgctctccttaggcttaacacccaacttcaaatcaaatttcgacctagcagaagatgcaaaactacaactttccaaagatacttatgacgacgacttggacaacttactagctcagataggagatcaatatgctgatctatttttagccgccaaaaatctctcagacgcaatcttactaagtgatattctaagagtaaatacagaaataaccaaagcccctctatccgcaagtatgatcaaaagatacgacgaacaccaccaagacctgacgctactaaaagccctagtacgtcaacaattaccagaaaaatacaaggaaatattctttgatcaatccaagaacggatacgccggatacatagatggaggggcatcacaagaagaattttacaaatttataaaaccaattctagagaaaatggatgggacggaagaactattagtgaaactaaaccgagaagacttactacgtaaacaaagaacgttcgataatggctctataccacaccaaatccacttaggagaactacacgccatattacgacgccaagaagacttttatccattcctaaaagataatcgagagaaaatagagaaaattttaaccttccgaataccgtattacgtaggccctctcgcgcgtggtaactcaagattcgcatggatgactagaaaatcagaagaaactatcacaccatggaacttcgaagaagtcgtagacaaaggagcgagtgctcaatcttttatagaaagaatgactaacttcgataaaaatttaccaaatgaaaaagtactaccaaaacacagcttgctatatgaatacttcacagtatacaatgaacttacaaaagttaaatatgtaacagaaggtatgagaaaaccagccttcttaagcggagaacaaaagaaagcaatcgtcgatttattatttaaaacaaacaggaaagtaactgtcaaacaattaaaagaagactactttaagaaaatagaatgtttcgattcagtagaaatatcaggagtagaagaccgattcaacgcatcactggggacataccacgacctacttaaaataatcaaagacaaagatttcctagacaatgaagaaaacgaagatatacttgaagatatagtactaaccttaaccctatttgaagacagagaaatgatagaagaaagactaaaaacttatgcacacctatttgatgacaaggtgatgaaacaactcaaaagaagaagatacacaggttggggaagactatcaagaaaattaatcaatggcatcagagacaaacagtccggaaaaacaatactggactttctgaaatcagacggattcgccaacagaaatttcatgcaattaatacacgatgacagcctaacattcaaagaagatatacaaaaagctcaagtaagcggccaaggggactctctacatgaacacatcgctaacctagcaggatcaccagcaataaagaaagggattttacaaactgttaaagttgtagacgagctagtaaaagtcatgggaagacataaaccggaaaatatagttatagaaatggcacgtgaaaaccaaactactcaaaaagggcagaaaaactcaagagaaaggatgaaaagaattgaagaaggcataaaagaattagggagccaaattctaaaagaacacccagtagaaaacacacaacttcaaaacgagaaactgtatctttactatttacaaaacggtagagacatgtacgtagatcaagaattagatatcaaccgcctatctgattacgatgtcgaccatatagtcccacaatcattcttaaaagatgattcgatagacaacaaggtattgaccaggagtgacaaaaacagggggaaatcagacaatgtaccatcagaagaggtggtaaagaaaatgaaaaactattggcgacaacttttaaatgctaaattgataactcaaagaaagtttgataatctcacgaaagccgaacgtggcggcctgagcgaactcgataaagcaggtttcataaaacgacagcttgtcgaaactagacaaataacaaaacacgtcgcacaaatactggactcaagaatgaatactaaatacgatgaaaacgacaaattaataagagaagtaaaagtaataacactaaagtcaaaattggtatcagattttagaaaagatttccaattctacaaagttcgcgaaataaataattatcatcacgcacacgacgcttatctaaacgcagtagtaggaactgcactaataaagaaatatcctaaattagaatcagaatttgtatacggcgactataaagtgtacgatgtacgaaaaatgatcgcaaaatcagaacaggaaataggcaaagcaaccgccaaatactttttctattctaatatcatgaacttctttaaaacagaaatcacacttgcaaacggggaaatacgtaaaagaccccttatagaaactaacggggaaacaggagaaatagtatgggacaaaggcagagactttgcaacagtaagaaaagtactttcaatgccccaagtaaacatagtaaagaaaaccgaagtacaaacgggcggcttttcaaaagaatcaattttacctaaacgaaacagcgataaactaatagctagaaagaaagattgggatccaaagaaatatggaggatttgatagccccaccgtagcatattccgtccttgtagttgcaaaagtagaaaaaggaaaaagtaagaaattaaaatcggtcaaagaattattaggaattaccataatggaaagaagttcgtttgagaaaaacccaattgacttcctggaagcaaaaggctataaagaagtcaagaaagatctcattatcaaacttccaaaatatagtctatttgaactagagaatggaagaaaacgcatgctagcgagcgctggtgaactacagaaaggaaacgaactagcattacccagcaaatacgttaatttcctatatcttgcaagccattatgaaaaactaaaaggctccccagaagataatgaacaaaaacaactatttgtagaacaacataaacattatctagatgaaattatagaacaaataagcgagttctccaaaagggtaatactagcagatgcaaatttggacaaagtactttcggcatataataaacacagggataaaccaatcagagaacaagccgaaaatatcatacacttatttacattaaccaatttaggagccccagcggcatttaaatattttgatacaaccattgacagaaaaagatatacatcaactaaagaagtgcttgacgcaaccctaatacatcaatcgataacaggattatacgaaacgcgcattgacttaagtcaactaggcggtgactga

SEQ ID NO: 4861 - RNA, 4890 nt, synthetic construct
  misc_feature 1..4890: note = Cas9 variant
  source 1..4890: mol_type = other RNA
atgaatttcaaaatacttccaatagcgattgatttaggtgttaaaaacaccggtgtatttagcgcgttctaccaaaaaggaacgtcacttgaaaggctggataataaaaatggtaaggtctatgaactgtcaaaagatagttacacgctccttatgaataaccgaactgcacgaagacaccaacgaagaggcattgatagaaaacaactcgtcaaaaggttatttaaactcatatggactgaacaactgaacctagaatgggacaaagacacccaacaagccatcagtttcctttttaacagacgaggcttttcatttataaccgatggatattcccctgaatacctcaacatagtaccagagcaagtaaaagcaatcttaatggatatatttgacgactataatggcgaagatgatctcgactcttatctgaagctcgccactgaacaagaatccaaaatttcagaaatctacaacaaattaatgcaaaaaatattagaatttaaactcatgaaactatgtacggacataaaagacgacaaagtctcaacaaaaacactgaaagaaattacgagctatgaattcgaactattagcagactatctagcaaactattctgaatcactcaaaacacaaaaattctcatacaccgacaaacaaggaaatttaaaagaactctcatactaccatcacgataaatacaatatccaagagttcctaaaacgacacgcaactatcaatgatagaatactcgatacactactcactgacgatctggatatttggaacttcaacttcgaaaaattcgactttgacaagaatgaagaaaaactacaaaaccaagaagataaagaccatatccaagcacatctacaccatttcgtatttgcagtaaacaaaataaaatctgagatggcatcaggtggacgtcacagatcacaatactttcaagaaatcactaatgtactagacgaaaataaccaccaagaagggtacttgaaaaatttctgtgagaacctacacaacaaaaaatacagcaatttaagtgttaaaaatctagtgaacctaatcggcaacctaagtaacttggaattaaaacccctcaggaaatatttcaacgataaaatacacgcaaaagcggaccactgggacgaacaaaaattcacagaaacatactgccactggatactcggcgaatggagagtgggagttaaagatcaggataaaaaagacggtgcaaaatactcatacaaagatctatgcaacgagctaaaacagaaagtaaccaaggcgggactagtagatttcttactcgaattagacccatgcagaacaattccaccatacctagacaacaacaataggaaacccccgaaatgccaatcattaatcttaaatcccaaatttctagacaaccaatatcctaattggcaacagtacttacaagagctaaaaaaattacaatcaatacaaaattacttggattctttcgaaaccgatctaaaagtacttaaaagtagtaaggaccaaccatacttcgtagaatataaatccagtaatcaacaaatagcgagcggacaacgagactacaaggatcttgacgccagaattttacaatttatatttgatcgagtaaaagcttctgacgaattattactaaacgaaatttacttccaggcaaaaaaactgaagcaaaaagcatcctcagagctcgagaaattggaatcttcaaaaaaactagatgaggtaatagcgaattcacaactttcccaaatactaaaaagtcaacataccaacggaatattcgaacaggggacattcctccatctcgtgtgtaaatattataagcagagacaaagagctcgagattcacgtctatatatcatgcctgagtaccgatacgataaaaaattacataaatacaacaatactggtagattcgacgatgataatcaactactaacctattgcaatcataaaccaagacagaaacgataccaactcttaaacgatttagcgggagtactccaagtatcccctaattttctaaaagataaaatcggaagtgatgacgacctcttcatctcgaaatggctggtagaacacatacgcggcttcaagaaagcatgtgaagactccctaaaaatacaaaaagacaatagaggcctacttaaccataagatcaatatcgcacgtaacaccaaaggcaaatgcgaaaaagaaatatttaatctaatttgcaaaatagaaggctcagaagataaaaaaggtaattacaaacatggcttagcatacgaactgggggttttactatttggagaacccaacgaggcatcaaaaccagaatttgacagaaaaatcaaaaaattcaattcaatttatagcttcgcccaaattcaacagatagcctttgccgaaagaaagggaaacgcaaacacctgcgccgtatgtagtgcagataacgctcaccgcatgcaacaaattaagatcacggaaccagtagaagataacaaagacaaaatcatcttaagcgcaaaagcacaacgcctaccggcaataccaaccagaatcgtagatggagcggtgaaaaaaatggcaaccatacttgcaaaaaatatagtcgacgacaattggcaaaacattaaacaagtgttaagcgccaaacaccaacttcacatacccatcatcacggagagtaacgcatttgaattcgaaccggcgctcgccgacgtaaaaggtaaatctctaaaagatagaaggaaaaaagccctagaaagaattagcccagagaatatctttaaagacaaaaacaatagaataaaagaattcgccaaaggaataagcgcgtactcaggagcaaatttaacagacggcgattttgacggagctaaggaagaactagaccacattatacccagaagccacaaaaaatatggaaccctgaacgatgaagcaaatttaatatgcgtaacacgaggagataacaaaaacaaaggtaatagaatattctgtctcagagatttagccgacaattacaaattaaaacagttcgaaaccaccgacgacctagaaatagaaaaaaaaatcgctgataccatatgggatgcaaacaaaaaagattttaaatttggtaactaccgctcctttatcaacctaactccacaagaacaaaaagcattcaggcatgccctattcctagcagacgaaaaccctataaaacaagctgttatacgagctataaacaacagaaaccgaacatttgttaatggaacacaaagatactttgcagaagtcctagcaaacaacatttacctaagagcgaaaaaggaaaatttaaacacagataaaataagtttcgactactttggaatcccaactatcggaaatggaagaggcatagccgaaattcgacaactgtacgaaaaagtcgactcagatatccaagcatacgctaaaggcgataagccacaggcatcatattctcacctaattgatgcaatgcttgcattctgtatcgctgcagacgaacacagaaatgatggatcaataggactagaaatagataaaaactattcactatacccgctagacaaaaacaccggagaagttttcactaaagacatcttttcacaaattaagattacagataatgaattttccgacaaaaaattagtaagaaaaaaagctatcgaagggttcaacactcatagacagatgactcgagacggaatctacgcagaaaattacctacctatattaatacataaggaattaaatgaagtcagaaagggatacacttggaaaaattcagaagaaataaaaatctttaaaggaaaaaaatatgatatacaacaactaaacaaccttgtttattgtttaaaattcgtcgataaaccaataagcatagatatacaaatatccaccctagaagaattaagaaacattctaaccacaaacaatatagctgcgacggctgaatactattatatcaacctaaagacacaaaaactccacgagtactacatagagaactataacacagccctaggttataaaaaatacagcaaagaaatggaatttctgcgatctctagcataccgctcggaacgtgttaaaattaaatccattgacgacgtaaaacaggtactcgacaaagattcaaattttataataggaaagataactttaccattcaaaaaagagtggcaacgattataccgagaatggcaaaataccacaataaaagatgattacgaattcttaaaatcctttttcaacgtcaagtccatcactaaactccacaaaaaagtgcgaaaagactttagtttaccaatatcgactaacgaaggcaaatttttagtaaaaagaaaaacatgggataacaacttcatctaccaaatccttaacgactcagacagtagagcggatggtacaaaaccctttattcctgccttcgatattagtaaaaacgaaattgtcgaagcaataatagatagtttcacttcgaaaaacatattttggttaccaaaaaacatagaactacaaaaagtcgacaacaaaaatattttcgccatcgatactagcaaatggttcgaagtagaaacaccatcggacttaagagacatcggaatcgcaactatccaatacaaaatagataacaactcacgtccaaaggtaagagtaaaactagattatgtaatagacgacgacagtaagataaattacttcatgaaccattctcttttaaaatcaagatatcccgataaggtattggaaatcctaaaacaatcaacaataatagaatttgaaagtagcggatttaacaaaacaatcaaagaaatgttaggtatgaaactagccgggatttataacgagacatcaaataattga

SEQ ID NO: 4862 - RNA, 3162 nt, synthetic construct
  misc_feature 1..3162: note = Cas9 variant
  source 1..3162: mol_type = other RNA
atgaaacgaaactacatcctaggactagatataggcataacctctgtagggtacggcatcatagactacgaaacaagggacgtaattgatgcaggtgtccgattatttaaagaagcaaacgtagaaaataacgaaggcagaagatcaaaaagaggtgccagaagactcaaacgaaggcgacgacaccggatacaaagagtcaaaaaattactcttcgattataatttattaacagatcactccgaactgtccggcataaatccatatgaagcaagagtcaaaggactgtcccaaaaactatcagaagaagaattctcagctgcactactacacctcgccaaacgacgcggtgtacataacgtaaacgaagtagaagaagacacaggaaacgaactatccacgaaagaacaaatctcacgtaacagtaaagctttggaagaaaaatacgtcgcagagcttcaactagagagactgaaaaaagacggggaagtgaggggatcaataaatagattcaaaaccagcgattacgttaaggaagcaaaacaactactaaaagttcaaaaggcctaccaccaactagatcaatcattcatagatacatacattgacctactagaaacacgtagaacatactacgagggtcccggagaaggatctccgttcggatggaaggacattaaagaatggtacgaaatgctaatgggacattgtacatattttccagaagaattacgctctgtaaaatatgcttacaacgccgacttatacaacgctttaaatgacttaaataacttagtaataacaagagatgagaacgaaaaactagaatattatgaaaaattccaaatcattgaaaatgtattcaagcaaaagaaaaaacctacattgaaacagatagccaaagaaattctcgtaaacgaagaagatatcaaaggctacagagtaacatctaccggcaaacccgaattcaccaatcttaaagtataccacgatataaaagacataacagccagaaaagaaataatcgaaaacgcagaattactagatcaaatagcgaaaatactaaccatttaccagtcctccgaggacatacaagaagaattaacaaacctaaactcagaattaacacaagaagagatagaacaaatatctaacctcaaaggatacacaggaactcataacttaagcttaaaagcaatcaacctaatacttgacgaactttggcacacaaacgacaatcaaatagcaatctttaacaggctaaaactagtaccaaaaaaagtagacttatcgcaacaaaaagaaatacccacaacactagtcgatgacttcattctatcacccgtagtaaaaagatcattcatacaaagcattaaagttatcaatgccataatcaaaaaatacggattgcctaatgatataatcatcgaactagccagagaaaaaaacagcaaagatgcacaaaaaatgataaacgaaatgcaaaaacgaaatagacagacgaatgaacgaatagaagaaatcatacgtacaacaggtaaagaaaatgccaaatacctaatagaaaaaatcaaattacacgacatgcaagaaggaaaatgcctctattcccttgaagctataccattagaagacttactaaataaccccttcaattacgaagttgatcacataataccaagaagtgtatcattcgacaattcatttaacaataaagttctcgtaaaacaagaagaaaacagcaaaaaaggtaatagaactccattccaatatttatccagtagcgactccaaaatatcatacgaaacttttaaaaaacacatattaaatttagcaaagggaaaaggaagaataagcaaaacaaaaaaagaatacttattagaagaaagagacatcaacagattttcagtccaaaaagactttataaatagaaacttagtagatacccgctatgcaactcggggtctcatgaaccttttaagatcatatttcagggtaaacaacttagatgtcaaagtaaaatcaattaacggaggatttacttctttcttaagaagaaaatggaaattcaaaaaagaaaggaacaaaggttataaacatcacgccgaagacgcactaataatagcaaacgcagatttcatattcaaagaatggaaaaaattagacaaagcaaagaaagtaatggaaaaccaaatgtttgaagaaaaacaagcagaatcaatgccagagatcgaaacagagcaagaatacaaagaaatattcatcaccccccatcaaataaagcacattaaagacttcaaagactacaaatactcacatagagtagacaaaaaaccaaatagagaactcatcaatgacacattatactcgacacgaaaagacgacaaaggaaacaccctcattgtaaataatctaaacggcctatacgacaaagacaacgacaaactaaaaaaactcataaacaaatcacccgaaaaattactcatgtaccaccacgacccacaaacataccaaaaactcaaactgataatggaacaatacggagacgaaaaaaatcccctttacaaatactacgaagaaacaggaaactacttaacaaaatatagtaagaaagacaatggacccgtaataaaaaaaataaaatattatggcaataaactgaacgcacatttagacataacagatgactacccaaatagtagaaacaaagttgtcaaactaagcttaaaaccatacagattcgatgtatacctggacaacggcgtatacaaattcgtaaccgtgaaaaaccttgacgtcataaaaaaagaaaattactatgaagtgaactcaaaatgttatgaagaagcaaaaaaattaaaaaaaatttcgaatcaagcggaattcatagcctccttttacaacaacgacttaataaaaataaacggagaactctatcgagtaatcggagtaaataatgacctcctaaacagaattgaggtaaatatgatagacattacttacagagaatatctagaaaatatgaacgacaaacgcccaccacgaataataaaaacaatagcaagcaaaacacaaagcataaaaaaatactccactgacatccttggaaatctatatgaagtaaaatctaaaaaacatccacaaataataaagaagggatga

SEQ ID NO: 4863 - RNA, 4230 nt, synthetic construct
  misc_feature 1..4230: note = Cas9 variant
  source 1..4230: mol_type = other RNA
atgctatttaataaatgcataataatcagtataaaccttgatttctctaataaagaaaaatgtatgacgaaaccatattcaataggcttagacatcgggacaaatagcgtaggatgggcggtaataacagataattataaagtaccgtcgaagaaaatgaaagtattgggaaacacatccaaaaaatacatcaagaaaaacctcttaggcgttttactcttcgactccggaattacggcagaaggcagacgactaaagagaaccgcaagaagacgttatacacgaagaagaaatcgaatactttatctacaagaaatattcagtacagaaatggcaacacttgacgatgcatttttccagcgccttgacgatagtttcctcgttccagatgacaaacgagatagcaaatatccaatctttggtaatttagtagaagaaaaagtttatcatgatgagttcccaaccatatatcacttaagaaaatacctagctgatagtactaagaaagcagatctacgtctcgtatacctagcacttgcacatatgatcaagtatagaggacacttcttgatcgaaggagaatttaattccaaaaacaacgatattcaaaaaaacttccaagatttcctagacacctataacgcaattttcgaatcagacctgagcctagaaaactcaaaacaattagaagagatagtgaaagataaaatctcaaaattggaaaaaaaagaccgaatactaaaactattcccaggagaaaagaactcaggaatattctccgaatttcttaaacttatagtgggaaatcaagcggattttcgaaaatgctttaacttagacgaaaaagcaagtctacacttttcgaaagaatcatatgacgaagacctagagacattactaggttatataggtgatgactattccgacgtattcttgaaagcaaaaaaattatatgatgcaattttattaagtgggttcctgaccgtaacagataatgaaacagaagcaccacttagttcagccatgattaaaagatacaacgagcacaaggaagatctagccctactaaaagaatacatcagaaacatatccttaaaaacttataatgaagtattcaaagatgataccaaaaacggatatgccggctacatcgatggcaaaacgaaccaagaagacttctacgtttatttaaaaaacctattagcggaatttgaaggagccgactactttctagaaaaaatagatagagaggatttcttaagaaagcaacgcacattcgataatgggagtatcccataccaaattcatttacaagaaatgagggcaatactagacaaacaagctaaattctacccatttttggctaagaataaagaacgtatagaaaaaatacttacattcaggataccatactatgtaggcccattagccagaggaaatagtgatttcgcctggtcaataagaaaaaggaacgaaaaaatcacaccatggaactttgaagatgtcattgataaagaatcaagtgccgaggcattcatcaatagaatgacatcatttgatctatatcttcccgaagaaaaagtactacccaaacatagtctattatatgaaacttttaatgtatacaacgaactaactaaagttagattcatcgcagaatcaatgagagattatcaattcctagactcaaaacaaaaaaaagatatcgtcagattatactttaaagacaaaagaaaagttacagacaaagacatcatcgaataccttcacgcaatttacggatacgatggaatagaacttaaaggaatagaaaaacagtttaactcaagtcttagtacctatcatgatttattaaacatcataaatgacaaagaattcctagacgactcatcaaacgaagcaataatagaggaaataatccacacactaaccatatttgaagacagagaaatgataaaacaacggctatctaaatttgaaaatatctttgacaaatccgtactaaaaaaactatcacgaaggcattatacaggatggggcaaactgtccgctaaacttataaacggaataagagatgagaaatcaggaaacacaatattagactatctaattgacgatggaattagtaatcgaaatttcatgcaattaatacacgacgacgccctaagtttcaaaaaaaaaatacaaaaggcacaaataataggtgatgaagacaaaggaaatattaaagaagtcgttaagtccctacctggaagtcccgcaatcaaaaaaggaattcttcaaagcatcaaaatagttgacgaactcgtaaaagttatgggaggacgaaaacccgagtcaatcgtggtcgaaatggctagagaaaatcaatacacaaatcaaggaaaaagtaactcacaacaacgattaaaaaggttagaaaaatcgctcaaagaattaggatcaaaaatcttaaaagaaaatataccagccaaactctcaaaaatagataataacgccttacagaacgacagattatatctatactacctgcaaaacggaaaagacatgtatactggagatgacctagacattgacagattatctaactatgacattgaccacatcataccacaagcattcttaaaagacaattcaatcgacaacaaagtactcgttagttcagccagcaatcgaggaaaatcggacgatttcccaagcttagaggtagttaaaaaaagaaaaacgttctggtatcaactattaaaatccaaattaattagccaacgcaaattcgacaacctgacaaaagcagaaaggggcggactacttccagaagacaaggcaggctttatacaaagacagcttgtagaaacaaggcaaatcacaaagcacgtggcaagacttctagacgaaaaatttaacaataaaaaagacgagaataatagagcagtcagaactgtaaaaataatcaccctcaaatccacattggtaagccagtttcgaaaagattttgagctctataaagtaagagaaataaacgacttccaccacgcacacgacgcctatttaaatgccgtcatagcctccgcattacttaagaaatacccaaaattagaaccagagtttgtatatggagactacccaaaatacaattcatttagagaacgaaagtcagcgactgagaaagtctatttttactcaaacattatgaacatattcaaaaaatccatatctcttgcagatggaagagttatcgaacgccccctaatagaagtaaacgaggaaacaggagaatccgtctggaacaaagaatccgatttagcaaccgtaagaagagtgttgagctacccccaagttaatgtagtaaaaaaggtagaagaacaaaatcacggactcgacagaggcaaacccaaaggactattcaacgcaaatctgagtagtaagccaaaaccaaactctaatgagaacctcgtaggagctaaagagtatctcgacccaaaaaaatacggtggatatgccggtattagcaacagttttgctgttttagtaaaagggactatagaaaagggagcaaaaaaaaaaatcactaacgtattagaatttcaaggtatatcaatattagacaggataaactaccgaaaggacaaattaaacttcctgctagaaaaaggatacaaagatattgaacttataatagaactaccaaaatatagtctgtttgaattatcagacggctcacgacgcatgctcgcaagcatattatcaaccaacaataaacgaggtgaaatccataaaggcaaccaaatcttcctgtcccaaaagtttgtaaaacttctctaccatgcgaaaagaatatcaaacacaataaacgaaaatcatagaaaatacgtagaaaatcacaaaaaagaatttgaagaacttttctattatatactcgaatttaacgagaactatgtaggtgcaaaaaaaaacggaaaattactaaacagcgctttccaaagctggcaaaaccactcaatcgatgaactatgctcctcctttataggacctacaggttcagaaagaaagggtcttttcgaattaacctcccgtggttcggcagcagattttgaattccttggagttaaaataccacgctaccgtgattatactccatcaagccttcttaaagacgcaacactcatacatcaatccgttacaggattatacgaaacacgaatagacctagcaaaactaggggaaggatga

SEQ ID NO: 4864 - RNA, 3306 nt, synthetic construct
  misc_feature 1..3306: note = Cas9 variant
  source 1..3306: mol_type = other RNA
atgtggtatgcctcattaatgtccgcacatcatttgagagtgggtattgatgtaggtactcacagtgttggactagcaacactgagagtagatgaccatggaacaccaatagaattactctcagctttatcgcatatacacgactcaggagtaggtaaggaaggcaagaaagaccatgacacaaggaagaaactaagtgggatagcaagacgagcaagacgtctattgcaccacagaagaacccaactccagcaactcgatgaagtattaagagacttgggatttccaatacctacaccaggtgaatttttagatctaaatgaacaaacagatccttacagagtatggagagtaagagcacgattagtcgaagaaaaactacctgaagaactcagaggcccggctatatcaatggctgttagacatattgcaagacacagaggatggagaaatccatattcgaaagttgaatcattacttagtcctgctgaagaaagcccttttatgaaagcattaagagagagaatattagcaactaccggagaagtattagatgacggaataacgcccggtcaagcaatggcccaggtagcattaactcacaatataagtatgagaggtcctgaaggtatattaggtaaattacaccaaagtgacaatgccaacgaaatacgaaaaatatgtgcaagacaaggagtatcccctgacgtctgcaaacaactattgcgagcagtattcaaagcagattctccccgaggatcagcagtctcaagagttgccccggacccattacccggacaaggatcatttagacgagccccaaaatgtgacccagaatttcaaagatttagaattataagtatagtagcaaacttaagaatatcggaaacgaaaggagaaaatagacctcttaccgctgatgaaaggaggcatgtagttactttcttgacagaagattctcaagcggacctcacatgggttgatgtagctgaaaaattaggagtacacagaagagaccttcgaggaacagcagtacatacagatgacggagagagatctgcagccagaccaccaatagatgccacggacagaataatgagacaaacaaaaatatcatcacttaaaacatggtgggaagaagcagacagtgaacaaagaggagcaatgataagatatttatacgaagatccgacagatagtgagtgtgctgaaataatagcagaactaccagaggaagatcaggccaaattagattccttgcatctacctgcgggtagagctgcatactcaagagaaagtttgactgctctatcagatcacatgttagctactacagatgacctccacgaagcaagaaaacgactatttggagtcgatgacagctgggcaccacccgctgaagcaataaatgcacccgtaggtaatccatcggtagataggactttaaaaatagttggacgatacctatcagcagttgaaagcatgtggggaactcctgaggttatccatgtagaacacgtacgagatggatttacaagtgaaagaatggccgatgaaagagacaaggcaaatcgacgaaggtacaacgacaaccaggaggcgatgaagaaaattcaacgagattacggaaaagaaggatacatcagccgaggagacatagtaagacttgacgctttagaattacaaggttgtgcatgtctatattgtggtactacaattggatatcatacatgtcaattagatcacattgttccacaagcaggcccaggatcaaataatagaagaggcaatttagtagcagtatgcgaaagatgtaataggtctaaatcaaacacaccttttgcagtttgggcacaaaaatgtggaataccacacgtaggggttaaggaagcaataggaagagtaagaggttggaggaaacaaactccaaatacttcaagtgaggatttaacgagattaaagaaagaagtaattgctagattaagacgaacacaagaagatccagaaatagatgaacgtagcatggaatcggtagcttggatggcgaatgaattacaccataggatagcggcagcatacccagaaacaactgttatggtttacagaggaagtattacagccgcagctagaaaagcagccggaatagattccaggataaatctaataggagagaagggtagaaaagatagaattgatcgaaggcatcatgccgtggacgcttcagtagttgcattaatggaggctagcgtagcaaaaactctagcggagcgatcatcactacgcggtgaacaaagactgacgggaaaagaacaaacatggaaacaatatacaggcagtactgtaggtgctcgagaacactttgaaatgtggagaggacacatgcttcatttaacagaactatttaacgaacgtctagcagaagataaggtatacgtcacacaaaatataagactacgcttaagtgatggaaacgctcatacggtaaatcccagtaaattagtatcacatagattaggagatgggttaacagtacaacaaatagatagagcgtgtacaccagcattgtggtgtgcgcttacgagagaaaaagactttgacgagaaaaacggactaccagcgcgagaagatagagctatacgcgtccacggacacgaaataaagtcaagcgattacatacaagttttcagtaaaaggaagaaaaccgattcagatagagatgaaacaccattcggagccatagcagttcgtggagggtttgttgaaataggaccaagcattcatcacgctaggatatatcgagttgagggaaagaaaccagtatatgcaatgctaagagtatttacccatgacctactgtcacaaaggcacggagatttattttccgcagtgataccacctcaatcaataagcatgagatgtgcagaaccaaaacttagaaaagccataactacgggaaatgcaacatacttaggctgggtcgtggttggtgacgaattggaaatcaatgttgacagttttacgaaatatgccattggccgatttttagaagatttcccaaatactacaagatggcgaatttgcgggtatgatacaaattctaaattaacgctaaaacctatagttctcgcagctgaagggttagagaacccatcctcagcagtcaatgaaattgtagaacttaaaggatggagggttgcaattaatgtattaacaaaggtacatcctacagtagtaagaagagatgccctcggacgacctcgctattctagcagatcaaacctacccacatcgtggacaatagaatga

SEQ ID NO: 4865 - RNA, 4167 nt, synthetic construct
  misc_feature 1..4167: note = Cas9 variant
  source 1..4167: mol_type = other RNA
atgactaaaccatatagcatcggattggacataggcacaaacagtgtaggatgggcagtaacaaccgacaattacaaagttccaagcaaaaaaatgaaagtcttaggcaacacttcaaaaaagtacataaaaaaaaatttactaggcgtattactcttcgattcgggtataacagctgaaggaagacgactaaaaagaacagcacgaagaagatacacgcgtagaagaaaccgaatattatatttacaagaaatcttctcaacagaaatggcaacactagatgacgcctttttccaacggctagacgactcttttctagtacctgacgataagcgagactccaaatatcctatattcggcaatttagtagaagagaaggcataccatgacgaatttcctactatctatcacttaagaaaatatctagcggactcgacaaaaaaagccgacttacgattagtttacctagctttagcacacatgatcaaatacagaggtcattttcttatagaaggtgaatttaacagcaaaaataatgacatacagaaaaacttccaagatttccttgatacctataatgcaatcttcgaaagcgaccttagtttagaaaattctaagcaattagaagaaattgtaaaagataaaatttctaaactcgaaaaaaaagatagaatactaaaacttttcccgggagaaaaaaactcaggaatattctcggaattcttaaaattgatcgtaggcaatcaagccgatttcagaaagtgtttcaatctcgacgagaaagcgagcttacatttcagtaaagaatcttacgacgaagatcttgagacccttctaggatatatcggtgatgactactccgacgtatttcttaaagcaaaaaagttatacgatgctatacttctatcaggttttctaacagtaactgataatgaaacagaagctccactttcaagtgccatgataaaaagatataacgaacataaagaagacctcgctttactcaaagaatatatccgcaacatatcactgaaaacatacaacgaagtgtttaaagacgatactaaaaacggttacgcaggttatatagatggaaaaactaatcaagaagacttttacgtgtatttaaaaaaattattagcagagttcgaaggtgctgattacttccttgaaaaaatagacagagaagactttttaagaaaacagcgaacgttcgataacggatccatcccataccaaatccacctgcaagaaatgcgtgcaattctggataaacaagccaaattttatcctttcctagctaaaaacaaggaacgcatagaaaaaatccttactttccgaatcccatactacgtaggcccattggcaagaggcaacagcgactttgcctggtcaattcgaaaacgcaacgaaaaaattacaccatggaattttgaggatgtaatcgataaagaatcatcagcagaagcctttatcaataggatgacatcctttgatctttatctgccagaagaaaaagtactaccaaagcattcattactgtacgaaacatttaacgtttacaatgaactgacaaaagtaagattcatagcagaatcgatgagagactaccagttcttagattccaaacaaaaaaaggatatagttcgactttactttaaagataaaagaaaagtcacagataaagatataatagagtacttacacgccatatatggatatgatggaatagagctaaaaggtatagaaaaacaattcaacagctcactatccacatatcatgacttactaaatataataaacgataaagaattcttagacgacagctctaatgaagccataatagaggagataattcacacacttactatatttgaagacagggaaatgataaaacaaagactgtccaaattcgaaaatatcttcgataaatcagtattaaaaaaactttctcgacgacactacacaggttggggaaaactatccgccaaattaataaacggaataagagatgaaaagagtggaaacacaatacttgactacttgatagatgatggaatctcaaataggaatttcatgcaattaatacatgatgatgcattatcattcaaaaaaaaaatacaaaaagcgcaaattataggtgacgaagataaaggaaacataaaagaagttgttaaaagccttccaggctcaccagcaatcaagaaaggaatccttcaatcaatcaaaatagtcgatgaattagttaaggtcatgggaggtagaaaaccagaatcgatagtcgtggaaatggcacgagaaaatcaatatacaaatcaaggcaaatctaacagccagcagagactaaaaagacttgaaaaaagtctcaaagaactaggcagcaaaatactaaaagaaaacatacccgcaaaactatcgaaaatagacaacaacgcacttcaaaacgatcgcttgtatctatactatttacaaaacgggaaggacatgtacactggggacgacctcgatattgaccgactctcaaactacgatattgatcacataattccacaagcattcctaaaagacaattcaatagataataaagtactagtaagcagtgctagtaatcgaggaaaatcagatgacgtcccttctctcgaggtagtcaagaaaagaaaaacattctggtatcaacttcttaaaagcaaactcatatcacaaagaaagtttgataatctcactaaagcagaacgtggaggattatcaccagaagataaagcaggttttatacaaaggcaactcgtagaaacaagacaaattacaaagcatgtagcacgtttgttagacgaaaaattcaacaataaaaaagacgaaaacaaccgcgcagtacgcacagtaaaaatcattactttaaagagcacactcgtatcccaatttagaaaagattttgaactctataaagtccgagaaataaacgattttcaccatgctcacgacgcgtatttgaatgctgtagtagcaagtgctctactgaaaaaatatcctaaactagaacccgaattcgtatacggagactatccaaaatacaactccttccgagaaagaaagagcgccacagaaaaagtatacttctattcaaacataatgaacatatttaaaaaaagtataagtctagcagatggtcgcgttatagaaaggccattaatagaagtgaacgaagaaaccggagagtcagtatggaacaaagaaagcgacttagcaacagttagacgagtattatcatatccacaagtgaacgttgtaaagaaagtcgaagagcaaaatcacggattagatcgaggtaaacccaaaggtctgtttaatgcaaacttatcatcaaaaccaaaaccaaactcaaacgaaaacctagtcggagcaaaagaatacttagacccaaaaaaatacggaggctacgccggtatatcaaatagttttacggttcttgtaaaaggtacaatcgaaaaaggagctaaaaaaaaaataaccaatgtacttgaatttcaagggatatcaattctcgatcgcataaattatcgcaaagataaattaaacttcttactagaaaaaggatataaagacatagaattaataatcgaacttcccaaatactcactgttcgaactatcagacggatcaagaagaatgctagcgagtatactatcaactaacaacaaaagaggagaaatccataaaggtaaccaaatctttctatcccaaaaatttgtcaaactattatatcacgcaaaaagaatatcaaacactatcaacgaaaaccatcgaaaatatgtcgaaaaccacaaaaaggaattcgaagaattgttctactatatccttgaatttaacgaaaactacgtaggcgcaaaaaaaaatggtaaactattgaactctgcatttcaaagctggcaaaaccatagtatagacgaactttgctcttcattcataggtccaacaggttctgaacgtaaaggattatttgaacttacctctagagggtcagcagctgattttgaatttctaggcgttaaaatacccagataccgagattatacgccgtcatccttactgaaagacgcaacactaatccatcaaagtgtaacaggattgtacgaaacgcgcatagatcttgcaaaattaggggaaggatga

SEQ ID NO: 4866 - RNA, 3249 nt, synthetic construct
  misc_feature 1..3249: note = Cas9 variant
  source 1..3249: mol_type = other RNA
atggccgcgtttaaaccaaactcaattaattatatattaggattagatatcggaattgcctctgtaggttgggcgatggttgaaatcgacgaagaagaaaatcccataagattaatagatttaggagtacgtgtattcgagcgagcagaagtaccaaaaaccggcgactcattagcaatggcaagaagattagctcgatctgtaagaagactaacaagaaggagagcccatagactgttaagaacaaggcgacttttaaaacgtgaaggtgtactccaagctgccaactttgacgaaaacgggctaattaaaagccttccaaacacaccctggcaactaagggcagctgccttagatagaaaactaacacccttagaatggtcggcagttctattacacctgataaaacatagagggtatttatcacaaaggaaaaatgaaggtgagaccgcagataaagaacttggagcattgttaaaaggagtagcgggtaatgcacatgctttacaaacaggtgactttagaacccccgcagaactagcactcaacaaattcgaaaaagaatcaggacacattagaaaccaaagatctgactactcacatacattttcaaggaaagatttacaagcagaattaatcctattgttcgaaaaacaaaaagagttcggaaaccctcacgtatcaggaggtctaaaagaaggaatagaaacactcctaatgacgcaaagaccagcgctctccggagatgccgtacagaaaatgttaggacactgcactttcgaacctgcagaaccgaaagctgcgaaaaacacatatacagcagaacgctttatatggctcacaaaacttaacaatttgagaatcttagaacaaggttcagaaagaccactgacagacacagagcgagctaccttaatggacgaaccgtatcgaaagagcaaattaacctacgcacaagcaagaaaattgttaggattagaagatacagcattctttaaaggattacgatatggaaaagacaacgcagaagcctcgaccttaatggaaatgaaagcgtaccacgcaatctcgagagctttagaaaaagaaggtctaaaagataagaaatccccactaaacttatcaccggaactacaagatgaaataggaacagcattttcactctttaaaacagatgaagacataacaggaagactaaaagatagaatacaaccagaaatattagaggctttactaaaacatatatcatttgataaatttgtacaaatatcattgaaggctttgagaagaattgtacctttaatggaacaaggaaaaagatacgacgaagcctgcgctgaaatatatggagaccattatggaaagaaaaacacagaagagaaaatatacttacctccaataccagctgatgagattagaaacccagtagtacttagagcactttcgcaagctcgaaaagtgattaacggcgtagtaagaagatacggctccccggctagaatacatatagagacagcaagggaagttggcaaaagttttaaagaccgtaaagaaatagagaaaagacaggaagaaaacaggaaagaccgagaaaaagcagctgcaaaattcagagaatattttccaaactttgtaggagaaccaaaatcaaaagatatattaaaactgagactatatgaacaacaacatggcaaatgtctatactcaggaaaagaaataaaccttggaagactgaatgaaaaaggatatgtggagatcgatcatgcgctaccattcagccgaacatgggacgattcattcaataataaagtgctagtactaggatccgaaaatcaaaataaaggcaatcaaacgccgtatgagtattttaacgggaaagacaactcaagagaatggcaagaatttaaagcaagggttgaaaccagcaggttccctcgaagcaagaaacaaagaatattattacagaaattcgacgaagacggatttaaagaaagaaaccttaatgatacaagatatgtaaacaggtttctctgtcaatttgtagcagataggatgagattaactgggaaaggtaagaaacgcgtattcgcatcaaatgggcaaataacaaatctactaagaggattttggggactacgaaaagtaagagccgaaaacgacagacatcacgctctagatgcagtagtggttgcatgtagtacggtcgcaatgcagcagaaaataactagattcgtgagatataaagaaatgaatgcctttgatggaaaaacaatagacaaagaaaccggagaagtcctacatcagaaaacgcacttcccacaaccttgggaatttttcgctcaagaagttatgatacgagtatttggtaaaccagacggcaaaccagagttcgaagaagctgatacccttgaaaaattacgtaccctattagcagagaaactaagcagcagacccgaagcagtacacgaatatgtgactccgctatttgtaagtagggcaccaaatagaaaaatgtctggtcaagggcatatggaaactgtcaaatcagcaaaaagactagatgagggagtctcagtcttaagagtacccttaacacaattaaaattaaaagacttagagaaaatggtaaatcgagaaagagaaccaaaactatatgaagcactgaaagctagacttgaagcacacaaagatgacccagcgaaagcattcgcagaaccattttataaatacgataaagccggcaatagaacccaacaagttaaagcagtacgagttgaacaagtgcagaaaactggggtatgggtccgcaatcacaatggaatagcagataacgctacaatggtcagagtagatgtattcgaaaaaggggacaaatattacttagtaccaatatattcctggcaagtcgccaaaggaatacttcctgaccgggctgtagttcaaggaaaagatgaagaagattggcaattgatagatgacagctttaacttcaaattcagcctacacccaaacgacctcgttgaagtgatcacaaagaaagcaagaatgttcggttatttcgcaagttgtcaccgtggtacagggaacattaatataagaatacacgatttagaccacaaaatcgggaaaaacggaatactcgaaggaatcggagtaaaaaccgctttgtcttttcaaaaataccaaattgatgaattaggaaaagaaattagaccatgtagactaaagaaacgtccaccagttaggtga

SEQ ID NO: 4867 - RNA, 4005 nt, synthetic construct
  misc_feature 1..4005: note = Cas9 variant
  source 1..4005: mol_type = other RNA
atgaaaaagccttacaccattggactagacattggaacaaacagcgttggctgggccgtattaactgatcaatatgatctagtcaaacgtaaaatgaaaatagccggagattccgaaaagaaacaaatcaagaaaaatttttggggtgtacgactatttgacgaaggacaaacggcagccgaccgcagaatggccaggacggccaggagaagaatagaaagacgacgtaaccgcatatcatacctccaaggaatattcgcagaagaaatgtctaaaaccgatgccaacttcttttgccgcttaagcgattcattttacgtagacaatgagaaaagaaactcccgtcatcctttctttgccacaatagaagaagaagtagaatatcataaaaattaccctacaatttatcatctaagagaagaactggttaactccagcgaaaaagcagacctaagattagtctacctcgcgctcgcgcatataattaaatatagaggaaactttttaatagaaggagctttagatacacaaaatacgagtgtggatggtatatacaaacaatttatccagacgtataatcaagtatttgctagtggaatcgaagacggctcacttaagaaactcgaagacaataaagatgtagccaaaattctagtcgagaaagtcacgaggaaagaaaaactagaaagaatactcaaattatacccaggggagaaaagcgctggaatgtttgcacaatttatatctctcatagtaggaagcaaaggtaattttcaaaaaccatttgatttaatagaaaaatcggatatcgaatgtgcaaaagatagctatgaagaagatctcgaatcactcttggcgttgattggcgacgaatacgcagaactgtttgtcgcagccaaaaatgcatacagcgcagtcgtcctctcaagtataataaccgtagcagaaaccgaaactaatgcaaaactgtccgcatcaatgatagaaagattcgatacgcatgaggaagatctaggtgaattaaaagcctttataaaattgcacttaccaaaacactatgaagaaatatttagcaataccgaaaaacacggttacgcaggatacatcgatggcaaaacaaaacaagcagatttctacaaatacatgaagatgacactagaaaacatagaaggtgcagactacttcatagcaaagatagagaaggaaaacttcctcagaaagcaacgtacttttgataatggtgctatcccacaccaattacacttagaagaactagaggcaatattacaccaacaagctaaatactatccgtttctcaaagaaaactatgacaaaataaaatcattagtaacatttaggattccatatttcgttggacccttggcaaacggacaatccgagttcgcatggctaactaggaaagcggacggggaaatccgaccctggaatattgaagaaaaagtagacttcggtaaaagtgcagtagatttcatagagaaaatgacaaacaaagatacatatctaccaaaagaaaacgttttaccaaaacatagtttatgttaccaaaaatacctagtatataatgaactcacaaaagttaggtatattaacgaccaaggtaaaacatcgtattttagcggacaagaaaaagaacaaatattcaatgacctattcaaacaaaaacgaaaagtaaagaagaaagatctcgaactattcttaagaaatatgagtcacgtagaatcaccaactatagaaggactagaagacagttttaattcctcctatagtacataccatgatctactcaaagtagggataaaacaagaaattttagacaacccagtaaatacagaaatgttagaaaatatcgtcaaaatcttaacagtatttgaagataaacgaatgataaaagaacaactccagcaattttccgatgtactcgacggtgtcgtcttaaagaaacttgaaagaagacattataccggatggggacgattatcagcaaaactattaatgggcattcgagacaaacagagccacctaacaatcttggattacctaatgaatgacgatggactcaaccgaaatttgatgcaactcataaacgatagtaacttatctttcaaatcaatcatagaaaaagaacaagtcacaactgcagacaaagatatccagagcatagtcgctgatctagccggttcacccgctattaagaaaggcatattgcaatcattaaaaatagtggacgaattagtatcagtcatgggctacccaccgcaaacaattgtcgtagaaatggctagagaaaatcaaacaacaggaaaaggcaaaaataatagcagacctagatacaaatcacttgaaaaagccataaaagagttcggctctcagatattaaaagaacatcccacagataatcaggaactgaggaacaatagattatatctatattacttgcagaatggtaaagatatgtacactggacaagaccttgacatacacaatttatcaaattacgatatcgaccacatagtgccccaaagttttattactgacaattcgattgacaatctagtactcacatcatcagctggaaatagggaaaaaggcgatgatgtaccaccactagaaatcgtacgaaaacgaaaagtattttgggaaaaattataccaaggcaatttaatgagtaaaagaaaattcgactatcttacaaaagctgaacgaggaggactcactgaagccgacaaagcaagatttatacacagacaattagtagaaacgcggcagataactaaaaacgtagctaacatactacaccaaagattcaactacgaaaaggacgaccacggaaacacaatgaaacaagtaaggatagtgacattaaaatccgcgctagtaagccaattcagaaaacagtttcaactatacaaagttagagacgtaaatgattatcatcatgctcatgatgcgtacctcaacggcgttgtggcaaatacattattaaaagtgtatccacaattagaaccagaatttgtttacggagattaccatcaattcgactggtttaaagcaaataaggctacagcgaagaaacaattctacactaatattatgctattcttcgcacaaaaagatagaatcatagatgaaaatggagaaattctttgggacaagaaatacctcgatacagttaagaaagtaatgtcatacagacaaatgaacatagtcaagaaaacggaaattcaaaaaggagagttctcgaaagcaaccataaaaccgaaaggaaattccagcaaactcatacccagaaaaacaaattgggatccaatgaaatacggaggcttagactcgccaaatatggcatatgccgtagtcatagaatacgctaaaggtaaaaacaaattagtattcgaaaagaaaataattagagtcacaataatggaaagaaaagcattcgaaaaagacgaaaaagcgtttctagaagaacagggatatagacagcccaaagtattagcaaaactacctaaatatacgttatacgaatgtgaagaaggaagaaggagaatgctggcatctgccaacgaagctcaaaaaggaaaccaacaagtattacctaatcatttagtaacacttctacatcatgcggccaactgcgaagtttcggacggaaaaagtctagactacatagaatcaaacagagaaatgtttgcggaattactagctcacgttagtgagttcgcaaaacgttacactttagctgaagcaaacttaaacaaaataaaccaattattcgaacagaataaagaaggcgatattaaagccatagctcaaagttttgtagatcttatggcttttaatgcaatgggggcaccagcctcattcaaatttttcgaaactaccattgaaaggaaaagatataacaatcttaaagaactactcaactcaacaataatataccaatcaatcacaggattatatgaatcacgaaaaagattagatgactga

SEQ ID NO: 4868 - RNA, 4038 nt, synthetic construct
  misc_feature 1..4038: note = Cas9 variant
  source 1..4038: mol_type = other RNA
atgaaaaaaccatactcgattgggcttgacataggtacaaattcagtcggctgggcagtcgtaacggatgactacaaggttccagccaaaaaaatgaaagtgctaggcaatacagacaaatcacatatagaaaaaaaccttttgggcgcactattattcgactcaggaaatacagccgaagaccgtcgactaaaaaggacagcccgtagaagatatacaagacgaagaaacagaatcttatacttacaagaaatattttctgaagaaatgggaaaagttgatgattcattcttccaccgactagaagacagcttcttggtaactgaagacaaacgaggagagagacacccaatattcggcaacctcgaagaagaagtcaaatatcacgaaaattttcccacaatatatcatttacgtcagtatttagcggataaccctgaaaaagtagatttacgcttagtatacctcgcactagcccacatcataaagttcagaggacactttcttattgagggcaaattcgacacaaggaacaatgacgttcaacgactattccaagaatttttagcagtgtacgataacaccttcgagaatagctccctccaagaacaaaacgttcaagtcgaagaaatactaaccgataaaatctcaaaatccgcaaaaaaagatagagtactgaaactattcccgaatgaaaaaagcaatggacgatttgcagaatttttgaaactaatcgtaggcaaccaagccgactttaaaaaacactttgaattagaagaaaaagctccattacaatttagtaaagacacatacgaagaagaactcgaagtattattggctcaaattggtgataactacgcagaactatttctatctgcaaaaaaattatatgactctattctactatcaggcatacttactgttacagacgtaggaacgaaagcgccattatccgcgagcatgatacaacgttataacgaacaccagatggacttggcacagctaaaacaatttattcgacaaaaattgagtgacaaatacaacgaagtgtttagcgacgtatcaaaagacggttatgcaggttacatagatggtaaaacaaatcaggaagcattctacaaatacttaaaaggcctactaaacaaaatagagggatcaggatatttcctagacaaaatagaaagagaggatttccttcgtaaacaaagaacattcgacaatggatctataccacaccaaatacacctgcaagagatgagagcaattatacggcgccaagcagaattttaccccttcttagccgataatcaagatagaatcgaaaaactattaacattcagaatcccatactacgtaggaccgttagcacgaggaaaaagcgattttgcatggttatctagaaagtccgccgataaaatcacaccctggaactttgatgaaatcgtagacaaagaatcatcggcagaagccttcattaaccggatgacaaattatgacttatatttaccaaaccaaaaagtcctacccaaacactccttattatatgagaaatttaccgtatataacgaactcacaaaagtcaaatataaaacagaacaaggaaagacagctttttttgatgcgaatatgaagcaagaaatatttgatggcgtcttcaaagtataccgaaaagtaactaaagataaattaatggacttcctagagaaggaattcgatgaatttagaattgtagacctaacggggctagacaaagaaaataaggtcttcaacgcaagctatggcacctatcatgatctttgtaaaatattggacaaagattttttagataattcaaagaatgaaaaaatactggaagacatagtattaacacttaccctttttgaagatcgcgagatgataagaaaaagattagaaaactacagtgatctcctaacaaaagaacaagtaaaaaaattagaaagaaggcactacaccggatggggaagactatctgcggaattaatacatggaattagaaacaaagaaagcagaaaaactatactagattacctaatcgacgacggtaatagcaatagaaatttcatgcaactaataaacgacgacgcactatcctttaaagaagaaatagctaaagctcaggtaataggcgaaactgataacttaaatcaagtagtatctgacatagccggcagcccagcaataaaaaagggtatccttcaatctttaaaaatcgtcgatgaactagtaaagattatgggccaccaaccagaaaacatagtcgtagagatggcacgcgaaaaccaatttacgaaccaaggaagaagaaattcacaacaacgacttaagggattaaccgattctataaaagaatttgggtcacaaatattgaaagaacatccagtagaaaattcacaattacaaaacgaccgactatttctttattatcttcaaaatggacgtgatatgtacaccggtgaagaacttgatatagactatctaagccaatatgacattgaccacataattccacaagcttttataaaagataattccatagataatagggtactcacgtcatcaaaagaaaacagaggaaaatcagatgatgttcctagcaaagatgttgtaaggaaaatgaaaagctactggtcaaagctcctatctgcaaaattaataacacaaagaaaattcgacaaccttacaaaagcggaacgaggaggcctcacagacgacgacaaagcaggattcatcaaaaggcaactagtagaaactagacaaatcacaaaacacgtagctagaatattagacgaacgatttaacaccgaaactgacgaaaataacaagaaaatcaggcaagtcaaaatagtcacattgaaatcaaacctcgtctccaactttagaaaagaattcgaactttataaagtacgagaaataaacgattaccatcacgcacacgacgcataccttaatgcagtaataggaaaagccttactaggtgtatacccccaactagagccagagtttgtatacggcgactacccacactttcatggccacaaagaaaacaaagcaactgcaaaaaaattcttctatagtaacataatgaatttttttaaaaaagacgacgtccggaccgataagaatggcgaaataatatggaagaaagatgaacacataagtaacataaaaaaagtactttcctaccctcaagtaaacatcgttaaaaaagtagaagagcaaacgggaggcttcagtaaagaaagcatattaccaaaaggaaattctgacaaactaatcccaagaaaaactaaaaaattctattgggacacaaaaaagtacgggggatttgactcccctatcgtagcatattcaatcctagtaattgcagatatcgaaaaaggaaagtcgaaaaaactaaaaacagtaaaagctttggtaggggtaacaattatggaaaaaatgacctttgaaagagatccagtggctttcctagaaagaaaaggttacagaaacgtacaagaagagaacattataaaactcccaaaatacagcctatttaaacttgaaaacggaagaaaaaggctactggcatcggctcgagaactgcagaagggaaacgaaatagtgctaccaaatcatttaggaaccttgctatatcacgcaaaaaatatccataaggtcgatgaaccgaaacacttagattacgtagataaacataaagatgaattcaaagaactcctagatgtggtaagtaattttagcaaaaaatatacccttgcagagggaaacctagaaaaaataaaagaactctatgctcaaaacaacggcgaagatttaaaagaactagcttcatcattcattaatctactaacattcacagcaatcggtgccccagcaacatttaaattttttgacaaaaacatcgacagaaaacgatatacatctacaacggaaatactcaatgcaacactaatccatcaatcaattactggcctctacgaaactcgaattgaccttaataaactcggaggcgattga

SEQ ID NO: 4869 - RNA, 3171 nt, synthetic construct
  misc_feature 1..3171: note = Cas9 variant
  source 1..3171: mol_type = other RNA
atgcaaactacaaacctgtcgtacatattagggctagacctaggaatcgctagcgtaggctgggctgtcgtagaaataaatgaaaatgaagacccaataggactaatcgacgtaggtgtgcgaatcttcgaaagagcagaagttcctaaaacaggagaatcgctagcactctcacgtcgacttgccagatccacccgtaggttgatacgtagacgtgcacacagactactattagcgaaaagatttctaaaaagagaaggcatactttccacaatagatctcgaaaagggattacctaatcaggcttgggaacttagagtagcaggacttgaacgtcgattaagtgcaattgaatggggagcagtactattgcacctaataaaacatagaggctatctctcaaaaagaaagaatgaaagccaaacgaacaataaagaactaggagcattgctaagcggtgtagctcaaaaccatcaactactgcaaagcgatgattacagaacaccagccgaattagcactaaagaaattcgcaaaagaagaaggccatatcagaaaccaacgaggggcatatacgcacactttcaacagactagatttactcgctgaattgaacctattattcgcacaacaacatcaatttggcaatccacattgtaaagaacacatacaacaatacatgacagaactacttatgtggcaaaagccagccctctctggcgaggcaattctaaagatgctaggcaaatgcacacacgagaaaaatgaatttaaagcagcaaaacatacttactccgccgaaagatttgtatggcttactaaacttaacaacttaagaatcctagaagacggcgcagaaagagcactaaatgaagaagaacgacaactattaataaatcacccttacgaaaaatcgaaactaacatacgcgcaagtaagaaaacttctcggtttatcagaacaagcaatattcaaacatttaagatattctaaagaaaatgcagaaagcgcaaccttcatggaattaaaagcatggcacgctataagaaaagctcttgaaaaccaagggttaaaagatacatggcaagatctagcaaagaaacccgacttactagacgaaatcggaacggcttttagcctatataaaacagatgaagatatacaacaatacctcacgaataaagtaccaaacagtgttataaacgcactattagtctcattaaactttgataagtttatagagttatcactaaaatcgctccgaaaaatattacctctaatggaacaaggtaaacgttacgaccaggcttgccgtgaaatatatggacatcactacggggaagcaaatcagaaaacttcacaactattacccgcaatacctgcccaagaaataagaaatccggtagtactaagaacactatcacaagcacgaaaagtaataaatgccataataagacaatacggatctccagcaagagtacatatagaaacagggagagaattaggtaaatctttcaaagaacgaagggaaatccaaaaacaacaagaagataatagaacaaaaagagaatcagctgtacaaaagtttaaagaactattctccgatttctcttcggaaccaaaaagtaaagatatattaaaatttagactctatgaacaacaacacggcaaatgcttatattcaggcaaagaaataaatatacatcgactcaatgaaaaaggatacgttgagatcgaccacgcacttccgtttagtaggacctgggatgactcatttaacaataaagtcctagtattagcatcagagaaccaaaataaaggaaatcaaactccttacgaatggttacaaggcaaaatcaactcagaacgatggaaaaacttcgtagcattagtattaggaagtcagtgctcggcggccaagaaacaaagactacttacgcaagtaattgatgacaacaaattcatcgatagaaacctaaacgacaccagatacatagcgagatttttatccaattacatacaagaaaatttattattagtaggtaaaaacaagaaaaatgtattcacacccaacggacagataacagcgctattacgatctcgatggggattaataaaagcccgagaaaataacaacagacaccacgcattagatgcaatagtagtagcttgcgcaacacctagcatgcaacagaaaattacccgatttatcagattcaaagaagtgcacccttataaaattgaaaaccgatacgagatggtagaccaagagagcggagagatcatatccccacactttccagaaccatgggcatatttcagacaagaagtcaacatacgagtctttgataaccatccagacactgtgctgaaagaaatgttacccgatcgcccacaagcaaatcatcaatttgtacaaccccttttcgtttcaagagccccaactagaaagatgagtggacaaggacacatggagactataaaatcggccaaacgactagccgaaggaatatccgtactaagaatacccttaacacaactaaaaccaaatctactggaaaatatggtaaacaaagaaagagaaccagctctatacgcaggcctaaaagcaagactagcagagttcaaccaagatccagcaaaagcattcgcaaccccattctacaaacaaggaggacaacaagttaaagcaatccgagtcgaacaagtccaaaaatctggagtactggttcgcgaaaacaacggagtagcagacaatgcgtcaattgtaagaaccgacgtattcattaaaaacaataaattctttctcgtacccatatacacatggcaagtggctaaggggattctacccaacaaagctatagtagcccataaaaatgaagacgaatgggaggaaatggacgaaggagcaaaatttaaattctctctttttcctaacgaccttgtcgaattaaaaacaaagaaagaatactttttcggatattacatcggattagacagagcaaccggaaacataagtctaaaagaacacgacggagaaataagcaaaggaaaagacggagtatatagagtaggagttaagctcgcattatcatttgaaaaatatcaagtcgacgaactgggcaaaaatcgacaaatatgccgtccccaacaaagacaaccagtcagatga

SEQ ID NO: 4870 - RNA, 3249 nt, synthetic construct
  misc_feature 1..3249: note = Cas9 variant
  source 1..3249: mol_type = other RNA
atggccgccttcaaaccaaatcctataaactatatcttaggcttagacataggaatagcatccgttggatgggcaatggtggaaatagatgaagatgaaaatcctatatgcctaatagatttaggagttagggtatttgaaagagccgaagtaccaaaaacaggagatagccttgccatggcgagaagattagcaagatctgtaagaaggctaacacgacggagagcacatagactactacgagcaagaagactattaaagagagagggagttttacaagcagcagactttgatgagaatggattaataaagtcccttcctaatacaccatggcaacttcgagcagctgccttagacaggaagctaacaccattggagtggtcagctgtattattacatctaattaaacataggggttatttatctcaaaggaaaaacgaaggagaaacagctgacaaagaactaggggcactactaaaaggcgtggcagacaatgcccacgcattacaaacaggagattttagaacccctgcagaattagcactaaataagtttgaaaaggaatcaggacacatcagaaatcaaagaggggattattcacatacattttccagaaaagatcttcaagcagaactcattttattatttgaaaaacaaaaagaatttgggaatccacatgtaagcggaggactaaaagaaggaatagaaacattacttatgacacaaagaccagcactaagtggggatgcagtccagaaaatgttaggacattgcacatttgaacctgccgaaccaaaagctgcgaaaaacacatacacagcagaaagatttatttggttaacaaaactcaacaatctaagaatactcgaacaaggttctgaaaggccattaactgacacagaaagagcgacactaatggacgaaccatacaggaaatcaaaattgacttatgcacaagccagaaaattgttaggactagaagataccgctttctttaaaggactgagatatggtaaagataatgccgaagcgtcaaccctgatggaaatgaaagcatatcacgctataagtagagctctggaaaaagaaggattaaaagacaagaaatctccattaaacctatcgccagaattacaagatgaaataggtactgcattttccctttttaaaacagacgaagatattacgggaagattaaaggaccgcatccaaccagaaattttagaggctttactaaaacacatatcatttgataagttcgttcaaataagtctgaaagcattaagaagaatagttcctttaatggaacaagggaaaagatatgatgaagcatgtgcagaaatatatggtgaccattacgggaagaaaaacacggaagagaaaatatatttgccaccaataccagctgatgaaattaggaacccagtcgtattacgagcattatcacaagcaagaaaagttatcaacggtgtagtgcgacgatatggtagcccggctcgaatacacatagaaacagcaagagaagtaggaaaaagttttaaagacagaaaagaaatagagaaaagacaagaagaaaatcgcaaagatagagaaaaagccgccgcaaaatttagagaatacttccccaattttgtaggtgaaccaaaatcaaaagacatacttaaactaagactatacgaacaacagcacggaaaatgtttatattccggcaaagaaatcaatcttggtagactcaatgaaaaaggttatgtagaaatagatcatgcactaccgtttagcagaacatgggatgatagcttcaataataaagtacttgtattaggaagtgaaaatcaaaataaagggaatcaaacaccatatgaatacttcaacggaaaagataacagcagagaatggcaagagttcaaagctcgagtagaaacaagcagattccctcgtagtaagaaacaacgcatattgctccaaaaattcgacgaagatggcttcaaagaaagaaatctaaatgatacgagatacgtcaatagatttttgtgtcaatttgtcgctgacaggatgagactaacaggtaaaggcaaaaagagagtattcgctagcaatggacaaataactaacttattgcgcggattttggggattaagaaaagtaagagcagaaaacgacagacaccatgcattggacgcagtcgtagtagcatgcagcacagtagcaatgcaacaaaagataactagattcgtacgatataaggaaatgaacgcattcgatgggaaaacaattgataaggaaacaggtgaagtactacatcagaagactcattttccacaaccttgggaatttttcgcccaagaagttatgattcgagtatttggaaaaccagatggaaaaccagaatttgaagaagccgatactccagaaaaactacgcacattactcgcggaaaaactatcaagcagaccagaagcagttcatgaatatgttactccacttttcgtatcaagagcacctaatagaaagatgtcgggtcaaggacacatggaaacagtaaaaagtgccaaaagactagatgaaggcgtaagtgtgttaagagttcccttgacgcaactaaaactaaaagatttagagaaaatggtcaatagagaaagagaacccaaattatacgaagcactcaaagcaagattagaagcacataaggatgatccagcaaaagcatttgctgaacctttctataaatatgataaagcgggtaacagaacccaacaagttaaagcagtaagagttgaacaagtacagaaaacaggcgtttgggtaagaaaccacaacggaatagcagataacgctacaatggtaagagtagatgtgtttgaaaagggagataagtactatttggtaccaatctatagctggcaagttgctaaagggatactacctgaccgtgcagtagtacaaggaaaagatgaagaagactggcaactaatcgacgactcatttaatttcaaatttagtttacaccctaacgacttagtcgaagttataactaagaaagctaggatgtttggatattttgcaagctgccataggggcactggaaatataaatataagaatacacgatttagatcataaaattggtaaaaacggaatattagaaggaataggcgtcaaaactgcattatcttttcaaaaatatcaaatagatgaattaggaaaagaaattagaccatgtagactcaagaaacgacctccagtccgatga

SEQ ID NO: 4871 - RNA, 3255 nt, synthetic construct
  misc_feature 1..3255: note = Cas9 variant
  source 1..3255: mol_type = other RNA
atgaaatatcatgtaggtatagacgtcggaacattttcagttggactggctgcaatcgaagtagatgacgcaggcatgcccataaagactctaagtttagtatctcacatacatgatagcggattagacccagatgaaataaaaagtgcagtgacaagacttgccagtagtggtatagcaagaagaacaagaagattatacagaagaaagagaagaagattacaacagttagataagtttatacaaaggcaagggtggccagttatcgaactagaagattacagtgatccactatatccatggaaagtgcgagctgaattagccgctagctatatcgctgacgaaaaagaaagaggagaaaaactatcagtcgcccttcgccatattgcacgacacagaggctggcgaaacccctatgccaaagtaagttcactatatttacctgatggtccatctgatgcttttaaagcaataagagaagaaattaaaagggcaagcggtcaacctgtaccggaaacagctacagtaggacaaatggttacgctatgtgagttaggaactttgaaactaaggggagaaggaggggtactaagtgcaagattacaacaaagtgattatgcaagggaaattcaagaaatttgtagaatgcaagagataggtcaagaattatacagaaaaattatcgatgttgtttttgcagcggaaagtccgaaaggaagtgctagcagccgtgtagggaaggatccattacaaccaggtaaaaatcgcgcattaaaagcaagcgatgcgtttcaacggtacagaatagcagcattgatcggaaacttaagagtaagagtggatggggaaaagagaatcctttcggtagaggagaaaaatctagtatttgatcatctagttaacttaacacctaagaaagaaccagaatgggtaaccatagcggaaatactaggtatagatcggggacaattaataggaaccgccactatgactgatgatggtgaaagagccggagccagacctccaactcacgacactaatagatcaatcgtaaatagtagaatagcacctttagtagattggtggaaaacggcgtctgcactagaacaacatgctatggtaaaagccttaagtaatgccgaagttgatgactttgattctccggaaggagccaaagtacaagcattctttgctgatcttgatgacgacgtacatgctaaactagattcactgcatttgcccgtaggtagggcggcgtacagtgaagatactctagtacgattaacaagacgtatgttaagtgatggggtagatctatacactgcaaggctacaggagttcgggatagaaccgagttggacgccacccacaccaagaataggtgaacccgtaggcaatccagctgtagatagggttctaaaaacagtaagtaggtggcttgaatcagcaactaaaacatggggtgctccagaaagagtgattatagaacatgtgagagaagggttcgtcacagagaaaagagctagggaaatggacggagatatgaggcgtagagcggccagaaacgcaaaattattccaagaaatgcaagaaaaattgaacgtacaaggaaaaccttcaagagctgatctatggagatatcaaagtgtacagagacaaaattgccaatgcgcatactgtggaagcccaatcacatttagcaattcggaaatggaccatatagtacctcgagcgggtcaaggatcaacaaatactcgagaaaatctagtagcagtatgtcatagatgcaatcagtcaaaagggaatacaccatttgcaatctgggcgaaaaacaccagtatagaaggtgtaagcgtaaaagaagcagtagaacgaaccaggcattgggtaacagatacaggaatgcgaagcacggactttaaaaagtttacaaaagcagttgtagaaagattccaaagagcaacaatggacgaagaaatagatgctcgatcaatggaatcagtagcttggatggcaaacgaactaagatctagagtagcacaacattttgcatcacatggaaccacggtaagagtatatagaggtagtttaaccgcagaagctagacgagcatcaggaattagtggaaaactaaaattctttgatggagttggtaagtcgagattagatagaagacatcatgcgatagatgcggctgtaatagcatttacaagtgactatgtggcagaaactttagctgtaagaagtaacttaaaacaatcgcaggcacatagacaggaagctccacaatggagagagtttacaggaaaagatgccgaacatcgggcggcatggagagtttggtgtcagaaaatggaaaaacttagcgcactactaacagaagaccttagagacgatcgggtggttgttatgagtaatgttagactacgattaggaaatggaagcgcccacaaggaaacgatagggaaactatcaaaagttaaattatcatcacaactgagtgtgtcagatatagacaaagcatcatccgaagcattgtggtgtgcattaactcgagaaccaggatttgatccaaaagagggtctaccggcaaatcccgaacggcatataagggtaaacggcacacacgtctatgccggtgataatatcgggttattcccggtaagcgcaggaagtatcgcactaagagggggatatgcagagctaggctcatccttccatcatgcacgagtgtacaaaattacgagcggcaagaaaccagcatttgctatgcttagggtatatacaattgatctattaccatatagaaaccaagatttatttagtgttgaactaaaaccacaaacaatgtcaatgagacaagcagaaaagaaattaagagatgctttagccactggaaatgccgaatatctcggatggctggttgttgatgatgaacttgtcgtagatacttcaaaaatagccaccgatcaagtgaaagcagtagaagctgaactagggactattagaagatggagagtagacggcttctttagcccatcaaaattaaggctaagaccactacaaatgtctaaagaaggcattaagaaagaaagcgccccagaattatcaaaaattatagatagaccgggttggttacccgctgtgaataaactattttccgatggtaatgtaacagtcgtgagacgtgactctcttggtcgagtaagactagaaagtactgcgcacctaccagttacatggaaagtgcaatga

SEQ ID NO: 4872 - RNA, 2955 nt, synthetic construct
  misc_feature 1..2955: note = Cas9 variant
  source 1..2955: mol_type = other RNA
atggcaagaattctcgcatttgatatcggaatctcatcaataggatgggcattcagcgaaaacgacgaactaaaagattgtggggtgcgcatatttacaaaagtcgaaaatccaaaaactggagaatcgttagcactaccacgaagattagctcgatctgcccgaaaaagacttgcccgaaggaaagcaagacttaatcacctaaaacatctaatagcaaacgaattcaaactaaattacgaagactatcaaagctttgacgaatcattagccaaagcatataaaggaagcctcatatctccatatgaattaagatttagggctctgaacgaactattatcaaaacaagactttgcaagagtaatattacacatagcaaaacgaagaggatacgatgacatcaaaaattccgacgataaagaaaaaggagctatactaaaagcaattaaacaaaacgaagaaaaacttgctaactaccaatcagtgggagaatacctatataaagaatacttccaaaaattcaaagaaaatagcaaagaattcacaaatgtcaggaacaaaaaagaaagttatgaacgatgcatagctcaatcattcttaaaagatgaattaaaactaatatttaaaaaacaaagagaattcggattttccttcagcaaaaaatttgaagaagaagtacttagcgtcgcattttataaaagggcactcaaagacttcagccacctagtagggaactgctcattctttaccgatgaaaaaagagcaccaaaaaattcgcccttagccttcatgttcgtagcactcacaaggataatcaatctactaaataatttaaaaaacacagaaggaatactttatacaaaagacgatctaaacgcattacttaacgaagtactcaaaaatggaactcttacatacaagcaaacaaaaaaactactaggactatccgacgattacgaatttaaaggagaaaaaggcacatatttcattgaattcaaaaaatacaaagagtttataaaagctctcggagagcataatctatcccaagacgacttaaacgaaatcgccaaagacataaccttaataaaagacgagataaagttaaaaaaagcactcgcaaaatacgatctgaaccagaaccagatagatagcctctcaaaactggagttcaaggaccacctcaatataagcttcaaagcattaaaactagtaactcccctgatgctggaaggaaaaaaatatgatgaagcctgcaacgaattgaacctaaaagtagccatcaatgaagacaaaaaagatttcttaccagcatttaatgaaacatactataaagatgaggttacaaatcccgtagtacttagagcaattaaggagtaccgaaaggttttaaatgctctacttaaaaaatacgggaaagtacacaaaatcaacatagagttagcacgagaagtagggaaaaatcactctcaaagggccaaaatagaaaaagaacaaaacgaaaattataaagcaaaaaaagatgcagaactagaatgcgaaaaactaggattaaaaataaactccaaaaatatattgaaattacgtctattcaaagaacaaaaagagttttgcgcatattcaggagaaaaaatcaaaatctcagatttacaggatgaaaagatgctagaaattgaccacatatacccatactccagatcattcgatgatagctacatgaacaaagtactagttttcaccaagcaaaaccaagaaaagctaaatcaaacaccattcgaagcctttggaaatgacagcgcaaaatggcaaaagatagaagtattagccaaaaacctcccaacaaaaaagcaaaaaaggatactcgacaaaaactataaagacaaagaacaaaaaaactttaaagatagaaacttaaatgacaccaggtacattgctcgactcgtattaaactacaccaaagactacctagacttccttcccctctcagacgacgaaaacactaagcttaacgacacccaaaaaggaagcaaggtacatgtcgaagctaaatcaggaatgcttacctccgcacttcgacatacatggggcttttcagcaaaagacaggaacaatcacctacaccacgccatcgatgcagtcatcatagcatacgcaaacaatagcattgtaaaagcatttagcgatttcaaaaaagaacaggaaagcaattcagccgaactgtatgcaaaaaaaattagcgaactagattacaaaaataaaagaaagttctttgaacctttctcaggattcagacaaaaagtactcgacaaaatagacgaaatattcgtaagtaaaccagagagaaagaaacctagtggagcattacacgaagaaacattcagaaaagaagaagaattctaccaatcatatggtggcaaagagggagtactaaaagcactagaactaggtaaaatacgcaaagtaaacggaaaaatagtaaaaaatggcgacatgtttagagtcgatatattcaagcacaaaaaaacaaacaaattttatgcagttcccatatataccatggattttgccttaaaagtcctaccaaataaagccgttgcaagatcaaaaaaaggagaaattaaagactggatcttaatggatgaaaactacgaattttgtttttccttatacaaagacagccttatccttatacaaaccaaagatatgcaggaacctgaatttgtctattataatgctttcaccagctcaaccgtttcactaatagtgtcaaaacatgataacaagttcgaaacactgagtaagaaccaaaaaatattgtttaaaaacgcaaatgaaaaagaagtgatagcaaaatctatcggaattcaaaacctaaaagtattcgaaaaatacatagttagcgcattaggagaagtaacaaaagctgaattccgacaaagagaagacttcaaaaaatga

SEQ ID NO: 4873 - RNA, 3366 nt, synthetic construct
  misc_feature 1..3366: note = Cas9 variant
  source 1..3366: mol_type = other RNA
atgtccgacctagtattaggactagacataggaataggctcagtaggagttggaattttaaacaaagtcacaggcgaaataattcacaaaaattcacgaatttttccggcagcccaagccgaaaataatctagtaagacgcactaatagacaaggacgaagactcgcaagacgaaagaaacatagacgagtaagattaaatagactattcgaagaaagtggactcataacagacttcacaaaaatttctataaatctaaacccttatcaattacgcgttaaagggctaactgatgaactatccaacgaagaattatttatagcacttaaaaatatggtaaaacataggggcataagttatttagacgatgcatccgacgacggaaacagctccgtaggtgactatgcacaaatagtaaaagaaaactctaaacagttagaaacaaaaacccctggacagattcaattagaaaggtaccaaacttatggccaattaagaggcgacttcacagtcgaaaaagacggaaagaaacatagactaatcaatgtatttccaacatctgcatatcgaagtgaagcgttgaggatacttcaaactcaacaagagttcaaccctcaaataacagatgaatttataaatagatatctagaaatactaacaggaaaaagaaaatattaccatggaccaggaaatgagaaaagcagaactgactatggacggtaccgaacaagcggtgaaacattagataatattttcggaatcctaatcggaaaatgcacattctaccccgatgaatttagagcggctaaagcatcatacacagcacaagagttcaatttactaaacgacctaaacaacttaacagtccccaccgaaacaaagaaactaagcaaagaacagaaaaaccaaattatcaattacgttaaaaatgaaaaagcaatgggacccgctaaactatttaaatatatcgcaaaactcctttcatgcgatgtagcggacataaaagggtacagaatcgacaaatcaggaaaagcagaaatacatactttcgaagcatatagaaaaatgaaaacattagaaacactagacatcgaacaaatggacagagaaacactagataaattggcgtatgtactaacactcaacactgaaagggagggaatacaagaagctcttgaacatgagttcgcagatgggagcttttcacaaaaacaagtcgacgaacttgtacaattccgtaaagcaaacagttcaatattcggaaaaggatggcataactttagcgtgaaattaatgatggagctaataccagaattatacgaaacaagtgaagaacaaatgactatattgacacgtctaggaaaacaaaagacaacgagttccagtaacaaaactaaatatatagatgaaaaactactaacagaagaaatttataaccccgttgtagctaaatccgtcagacaagctattaaaatcgtaaatgctgcaataaaagaatacggagatttcgataacatagtaatagaaatggcacgagaaacaaacgaagacgatgaaaagaaagcaatacagaaaattcaaaaagcaaacaaagatgaaaaagacgcagcaatgctaaaagccgcaaaccaatacaacggaaaagctgaactgccacattcggttttccacggacataaacaattagcaacaaaaataagattatggcatcaacaaggcgaaagatgcttatacacaggaaaaacaatctcaattcacgacctgattaacaacagcaatcagttcgaggtagatcatatcctacccctatctataacctttgatgactctctcgccaacaaagttctagtatatgccactgcaaatcaagaaaaagggcaaagaactccctatcaagcattagattcgatggatgatgcatggtcatttagagaactaaaagccttcgttagggaaagtaaaacattatcgaataaaaagaaagaatatcttttaacagaagaggacatctcaaaatttgacgttagaaagaaatttatagaacgcaatctagtcgacacccgatatgcgtccagagttgtattaaatgcactccaggaacattttagagctcataaaatagataccaaagtatcagtagtaagaggacagttcacaagccaattaagaagacactggggtatagagaaaacaagagacacctaccaccaccatgctgtcgacgcccttataatcgcagcttcaagccaactaaacttatggaagaaacagaaaaataccctggtaagctatagtgaagatcaactactcgatattgaaacaggagaattaatatccgatgatgaatacaaagaatccgtatttaaagcaccataccaacactttgtggacacattaaaatcaaaagagttcgaagactccatacttttctcataccaagtagattcaaaattcaaccgtaaaataagcgatgcaacaatttatgctacgcggcaagcaaaagtaggcaaagacaaagcagacgaaacctatgtgctgggaaaaataaaagacatatatacacaagacggatacgacgccttcatgaaaatatataagaaagataaatcaaaatttttaatgtatagacacgacccacaaaccttcgaaaaagtaatagaacccattctggaaaattatccaaacaaacaaataaacgaaaaaggcaaggaagttccctgtaacccattcttaaaatataaagaagaacacggatacattagaaaatattcaaagaaaggcaatgggccagaaataaaaagtttaaaatattatgacagtaaactggggaaccacatcgatataaccccgaaagactcaaataataaagtagtccttcaatccgtatcaccctggagagcagatgtctattttaacaaaacgaccggaaaatatgaaatactaggcttaaaatatgcagacttacaattcgaaaaaggtacaggaacttataaaatatcacaagaaaaatataacgacattaagaagaaagaaggagttgacagcgactcagagttcaaatttaccttgtataaaaacgacctccttcttgtcaaagacaccgaaacaaaagaacaacaactttttagattcctttcaagaacaatgccaaaacaaaaacactatgtagaattaaaaccctatgataaacaaaaattcgaaggaggggaagcgttaataaaagtcctcggtaacgtagccaactccggacagtgtaagaaaggcctaggcaaatcaaacatatccatttacaaagtaaggacagacgttttgggaaatcagcacatcattaaaaacgaaggagacaaaccaaaattagatttctga

SEQ ID NO: 4874 - RNA, 2556 nt, synthetic construct
  misc_feature 1..2556: note = Cas9 variant
  source 1..2556: mol_type = other RNA
atgacaaatggtaaaatacttggactcgatattggcgttgctagtgtaggagtaggaatcatagaagcgaaaacaggaaaagtaattcatgcaaatagccggttattctccgcggctaatgcagaaaacaacgccgaaagaagaggattccgcggagcaagacgactaacacgaagaaagaaacacagagtaaaaagagtaagagatctcttcgaaaaatacgatatcttaactgacttcagaaatttaaaccttaacccatacgaactacgggtcaaaggactaaccgaacaactcacaaacgaggaattattcgcagcacttcgaactatagcaaaaagacgcggcataagttacttagacgatgcagaagatgattcaactgggtcatccgattacgccaaatccatagacgaaaacagaagactattaaaatctatgacccccggacaaatacaactagaaagactagaaaaatatggacaactcagaggaaatttcacagtttatgacgaaaatggtgaagcccacagactaataaacgtattcagtacctccgattataaaaacgaagctagaaaaatattagaaacacaatcaaattataataaacaaataacagacgagttcatagaagattacatagaaatactaacacagaaaagaaaatactatcacggaccaggaaacgaaaaatccagaacagattatggaagatttagaaccgacggcacaactcttgaaaacatattcggcatactaataggtaaatgctcattctatccagaagaatacagagcatccaaagcgagctacacggcacaagagttcaatttcctgaacgatctgaacaatctaaaagtaccgacagaaacaggaaaattgtccacagaacaaaaagaatatctagtcaacttcgccaaaaattcaaaaacactcggagcaagtaaactactaaaagaaatagcaaaactcgtcgatggagatgtaaaagacataagtggatatagggaagactctaaaggtaaaccagatctacataccttcgaaccatataggaaacttaaatttaacctaacaacagtagacatagacaatttaagtagagatatattagataaacttgcagatatcctcacactaaacacagaacgagaaggaatagaagacgcaatcaatcaaaatctaccagaacaattcaccaaagaacaaatctcagaaatagtgcaaatacgaaaaagtcaaagctcagcattcaacaaaggatggcactctttctcagccaaactaatgaacgaactaataccagaattatacgcaacaagcgaggaacaaatgacaattttaacaaggctcgaaaaattcaaagcaacaaagaaatcaagtaaaaataccaaaacaatagatgaaaaagaaataactgacgaaatctataatccagtagtggcaaaatcagtaagacaaacaatcaaaataataaacgcagcagtaaagaaatatggtgattttgacaaaatagtaatagaaatgccaagagacaaaaatgcagatgacgagaagaaattcatagataagaaaaataaagaaaataagaaagaaaaagatgactcactgaaaagagcggcctatctatacaacggaactgacaaactacctgacgacgtattccacggaaacaaacagctagccacaaaaatcaggttgtggtatcaacaaggagaaagatgcctatacagcggaaaaccaatactaatacaagatctagttcacaactcaaacaacttcgaaatcgatcatatactacccttatcattaagtttcgacgacagcttagcaaacaaagtattagtatatgcatgggccaaccaagagaaagaacagaaaacgccctaccaagttatagattcaatggacgcagcatggtcctttagagaaatgaaagactacgtactaaaacaaaaaggtataggaaagaagaaaagagaatatctactaactacagaaaacatagataaaatagaagtaaagaagaaatttattgaaagaaatctagtagacactagatatgcaagtagagtagtactaaacagtttacaaacagcattaaaagaattaggaaaagacacaaaagttagcgtagtcagaggccaattcacatcccaactacgaaggaaatggaaaatagataaaagccgagaaacataccaccaccacgccgtagacgccctaataatagcagcaagttcccaactaaaattatggcaaaaacacgaaaatttaatgtttgaaaattacggagaaaatcaagtagtaaataaagaaacaggtgaaatactcagtataagcgacgacgaatataaagaatcggtatttcaaccaccctatcaagggttcgtgaatacaatctcgtcaaaagcgtttgaagacgaaattttattcagttaccaagttgactcaaaatttaatcgaaaagtctcagacgccacgatatattcgacaagaaaagcaaaactaggaaaagataagaaagaagaaacctacgtacttggaaaatga

SEQ ID NO: 4875 - RNA, 2598 nt, synthetic construct
  misc_feature 1..2598: note = Cas9 variant
  source 1..2598: mol_type = other RNA
atgagacacaaaatcggactagacatcggaataaccagtgttggctgggcagtaataaatctagatatacctcgtatcgaagatctaggagtacgaattttcgacagggccgaaaatcctcagaccggagaatcattagcactacccagaagacttgcaaggtctgccagaagaagactaagacgaagaaaacacagactggagagaatacgaagactcttaataagagaaggtatattaacaaaagaagaactagataaattatttgaagaaaaacacgaaatagacgtatggcaattaagagtagaagcattggataggaaactaaacaacgatgaattagcacgtgttctactacacttagcaaaacgaagaggatttaaatcaaatagaaaatcagaaagaaataacaaggagaacagcactatgctgaaacacatagaagaaaatagagcattgttatccggttacagaacagtagcagaaatgatagtaaaagacccaaaatttgcattccacaaaagaaataaaggagaaaactataccaatactatagcgagagatgacctagaaagagaaatcaaactaatatttacgaaacaaagagaatatggaaacattgtgtgtacagaaacatttgaaaacgaatatattatgatttgggcaagccaacgaccatttgcatcaaaaaacgatatagaaaaaaaagtaggtttttgtacttttgaaccaaaagaaaaaagagctccaaaagcaacatataccttccaaagttttgtcgcatgggagcatatcaataaactccgattggtctatccaaccggaacacgaggactaaccgacgaagaaagacgattgttatataaacaagccttccacaaaaataaaataacttatcatgatataagaactttacttcatttaccagatgacacatactttaaaggaatcgtttatgacagaggagccccactaaaacaatcagaaacaataagatttttagaactcgacgcttatcatcaaataagaaaagcagtagacaaagtatatggcaagggaaaaagttcatcattccttccaatcgactttgacacattcggatatgcactaacactattcaaagacgacgctgacataagatcatatttaagaaatgaatatgaacagaacggtaaaagaatgccaaatctagcaaacaaggtctacgataatgagcctatcgaggaactcttaaatctatcatttacaaaattcggacacctatctcttaaagcattacgcaacatacttccatacatggaacaaggagaagtttattcagtagcttgtgaaagggcagggtacaccttcacaggaccaaaaaaaaaacaaaaaacactactactaccaaacataccaccaatagcaaaccccgtcgtaatgcgcgcactcacacaagcaagaaaagttgtaaatgcaataatcaaaaaatacggttcgccagtatcgatacacatagaactcgccagagatctatcccaaacattcgacgaaagaagaaaaacaaaacgagaacaagatgaaaatcgtaaaaaaaacgaaacagccataaggcagttgatggaatacggactaaccattaaccctaccggacatgatattgtaaaatttaaactatggtccgagcaaaatggacggtgtgcctattctctacaaccaatagaaatagaaagacttctagaaccaggatacgttgaagtagaccacgtaataccatatagccgcagtctagacgactcttatacgaacaaagtacttgtgctaacaaaagaaaatagagaaaaaggtaaccgaataccagcagaatatttaggagtcgggacagaaagatggcaacaatttaaaacatttgtactaacaaacaaacaattctctaaaaaaaaaagagatagattactaagattgcactacgacgagaatgaagaagctgaatggaaaaaccgaaatttaaatgatactagatatatttcaagatttttcgccaattttatccgcgaacacctaaaatttgcagaatcagatgataaacagaaagtctacacagtaaatggaagagtgacagcccacttgaggagccgatgggattttaataaaaaccgagaagaaagtgacttacaccacgcagttgacgctgcaatagtcgcatgcacttcaccctccgacatagcaagagtaacagcattttatcaacgcagggagcaatgcaaagagagtgccaaaaaagcggaaccccacttcccccaaccctggcctcattttgctgatgaattacgagccagactatcgaaaaatcccaaagagtcaataaaagctttaaacttaggaaactatgatgaccaaaaactagaatctctacaaccagtgtttgtatcacgaatgccaaaacgctcagttactggagcagcacatcaggaaacattacgcagatatattggaatcgacgaaagatccggtaaaatacaaaccgtagtcaaaacaaaactttcagaaattaaattagatgaaacaggacacttcccaatgtatggcaaagaatcagaccccccagcaagtgcatga

SEQ ID NO: 4876 - RNA, 2886 nt, synthetic construct
  misc_feature 1..2886: note = Cas9 variant
  source 1..2886: mol_type = other RNA
atggcaagaatacttgcttttgatataggtattagcagcataggctgggccttctctgaaaatgacgaactcaaagactgtggcgtcagaatcttcacaaaagctgaaaatccaaaaacaggcgaatcactagcacttccccgaagactagcaagatcagcacgaaaaagacttgctcgccgaaaagcaagattaaaccatctaaaacatctaatagcaaacgaattcaaactaaactacgaagactaccaatcatttgacgaatctttagcaaaagcatataaaggctcactaatcagtccttacgaactcagattcagagcactcaacgaactactaagtaaacaggacttcgcaagagtaatactgcacatagcaaaaagaagaggatacgatgacataaaaaacaatggagacgaagaaaaaggaaaaatattaaaggcaataaaacaaaacgaagaaaaattagtgaactatcaaagcgtaggagaatacttatacaaagaatactttcaaaaattcaaagaaaattctaaagaattcattaatgtaagaaacaaaaaagaaagttacgaaagatgcataacacaaagtttccttaaatatgaactaaaactaatcttccaaaaacaaagagaattcggattctccttttccaaaaaattcgaagaagaagtactatccgtagcattttataaacgagcactaaaagatttcagtcaccttgtcggaaattgctccttcttcagcgacgaaaaaagagcaccaaaaaactccccactcgcatttatgttcgtcgcactaacacgaatcataaacttactaaataacctaaaaaatacagaaggtatcctttacacaaaggatgacttaaacgcacttctgaacgaggtactgaaaaatggaactctaacatacaaacaaacaaaaaaattattaggattaagtgacgactatgaattcaaaggcgaaaaaggcacatattttatagaattcaaaaaatacaaggaattcattaaagcattaggggaacataacctctcacaagacgacctaaacgaaatagctaaagatataactttgataaaggatgaaataaaactaaaaaaagccttagcaaaatacgacctaaaccaaaatcaaatagactcattatcaaaactagaattcaaagaccacctcaacatagggttcaaagcactaaaactaatcacccccttaatgttagaaggtaaaaaatatgatgaagcatgtaatgaactaaatttaaaagttgccatcaatgaggacaaaaaggactttctacccgcctttaatgaaacttattacaaagatgaagtcacaaaccccgtagtcttacgagcaataaaagaatacaggaaggtacttaacgcattattaaaaaaatacggaaaagtacacaaaattaacatagaactagccagagaagttggtaaaaaccacagccaaagagcaaagattgaaaaagaacaaaacgaaaactacaaagcaaaaaaagatgcagagctagaatgcgaaaaactcggactaaaaataaactccaaaaacatattaaaactccggttatttaaagaacagaaagaattctgtgcatactcaggtgaaaagataaaactgagtgacctacaggacgagaaaatgctagagatcgaccacatatacccatattccagaagctttgatgatagctatatgaacaaagtgctcgttttcacaaaacaaaaccaggaaaagctaaataaaactccattcgaagcattcggaaacgacaacgtaaaatggcaaaaaatagaagttttagctaaaaacctaccagaaaaaaaacaaaaaagaatattagacaaaaactacaaagacaaagaacaaaaagactttaaggataggaaccttaacgataccagatacatagctcgattagtattaaactacacaaaagactacctagacttcttacctctctcagacgacgaaaacaccaaactcaaaggatcaaaagttcatgtagaagcaaaatcaggaatgttaacaagcgcactaaggcatacatggggtttcagtactaaagacaggaataaccacctacaccacgcaatagacgcagcaattatagcctacgcaaataacagcatagtaaaagacttcagcgactttaaaaaagaacaagaatctaactcagccgaactctatgctaaaaaaatatccgaattagactacaaaaataaacgcaaatttttcgaacctttttcaggattcagacaaaaagtgttagataaaatagatgaaatatttgtatcaaaaccagaacgcaaaaaacctagcggcgctctacatgaagaaacatttagaaaagaagaagaattttatcaaagctatggaggcaaagaaggagtactaaaagcactcgaactaggaaaaattcgaaaggttaatggaaagattgtaaaaaacggagacatgttccgtgtagacatatttaaacacaagaaaaccaacaaattctatgccgtccctatatacacaatggattttgctcttaaagtactaccaaacaaagccgtagctagatcaaaaaaaggggaaatcaaagactggatcctaatggacgaaaattatgagttttgtttcagcctttacaaagacagtctaatccttatacagaccaaagacatgcaagaaccagaactagtatacttcaatgcctttaccagtagcacggtatccttaatagtaagtaaacatgataataagttcgaaacactcagtaaaaacctaaaagtattcgaaaagtatatagttagcgcactcggagaagtgactaaagcagagttccgacaaagagaagatttcaaaaacgaactacgctga

SEQ ID NO: 4877 - RNA, 2955 nt, synthetic construct
  misc_feature 1..2955: note = Cas9 variant
  source 1..2955: mol_type = other RNA
atggcaaaaatactagcattcgatataggcatatcgagcataggctgggccttctcagaaaacgatgaactgaaagactgtggtgttagaatatttaccaaagcggaaaacccaaaaacaggagaatccttagctctaccaagaagaatagcaaggtctgcaagaaagcgattagctagacgtaaagcaagattaaaccacttaaaacacctaatagcaaacgaatttaaactaaattatgaagactaccaatccttcgacgaaatcctcgcaaaagcttacaaaggatccttaataagtccttatgaattaaggtttagagcactcaacgaattactgtctaaacaagactttgcacgagtaattctacacatagccaaacgtagaggctatgacgatataaaaaacaacggagacgaagagaagggaaaaatactaaaagctataaaacaaaacgaagaaaaactggccaactaccaatctgtaggtgaatacttatacaaagaatactttcaaaaatttaaagaaaactcaaaagaatttatcaacgtaagaaacaaaaaagaatcatacgaaagatgcatagcacaatccttcctaaaagacgaacttaagttaatattcaaaaaacaaagagagttcggattctcattcagcaaaaagttcgaagaagaagtcctatccgtagcattctacaaaagagcactaaaggacttctcacatttagttggtaattgcagtttcttcacggatgaaaaaagggcaccaaaaaacagcccactagcattcatgttcgtagcacttacaagaataattaatcttttaaacaacctaaaaaatacactttatacgaaagacgacttgaatgcattattaaacgaagtcctaaaaaacggaaccttaacctataaacaaacaaaaaaactactcggtttatcagacgattacgaattcaaaggagaaaaaggtaattacttcatagaatttaagaaatacaaagaattcataaaagcactcggagaacattcactatcacaagacgatctaaacgaaattgcaaaagacattacactaattaaggatgagattaaattaaaaaaggcccttgcaaaatatgatttaaacgaaaatcaaattgataacctaagcaaattagaatttaaagatcacctaaacatatctttcaaagcgctaaagttaataaccccactaatgttagaaggcaaaaagtacgatgaagcatgcaatgaactaaccttaaaagttgcaatcaatgaagacaaaaaagactttctaccagcattcaatgaaacctactacaaagatgaagtaacaaaccccgtcgtcttacgagcaatcaaagaatatcgaaaagtactaaacgcactattaaaaaaatatgggaaagtacacaaaattaatatagaattagcacgcgaagtagggaaaaaccattcacaaagagccaaaatagaaaaagagcaaaacgaaaattataaagcaaaaaaagacgcagaactcgaatgcgaaaaactaggactaaaaataaatagtaaaaatattttaaaactaagactattcaaagaacaaaaagaattttgcgtatatagcggagaaaaaataaaattaagtgatctacaagatgaaaaaatgctagagatcgaccacatttacccctacagtcgatcattcgacgattcctatatgaataaggtgttagtattcaccaaacaaaaccaagaaaaactcaaccaaacaccattcgaagcattcggaaatgattctgctaaatggcagaaaatcgaagtattagctaaaaacctaccgaccaaaaaacaaaaacgaatactagacaaaaactacaaagacaaagaacagaaagacttcaaggatagaaatcttaacgatacccgatacatcgcaagattagttttaaactatacaaaagactacctagactttttgccgttatccgacgatgaaaacacaaaactcaatgatacacaaaagggttcaaaagtacacgtagaggcaaaatccggaatgctaaccagtgcgttaagacacacctggggattctctacaaaagatcggaacaaccacctccaccacgcaattgacgctgtaataatagcatacgcaaacaacagcatagttaaagctttttcagatttcaaaaaagaacaagaatcaaacactgccgaattatatgcaaaaaaaataagtgaactagattacaaaaacaaaagaaaattcttcgaacccttctcaggatttagacaaaaagtactagataaaatagacgaaatcttcgtatcaaaaccagaaagaaaaaagccatcaggcgcactacacgaagaaacattcagaaaagaagaagaattctatcaaagttacggtggcaaagaaggagttctaaaagctctagaactgggaaaaatacgaaaagttaacggaaaaatagtaaaaaacggtgatatgttccgagttgacatcttcaaacacaaaaaaacgaacaaattctacgcagtgccaatatacactatggacttcgcactaaaggtattaccgaacaaagcagtcgctaggagcaagaaaggagaaataaaagactggatactaatggatgaaaactacgaattctgcttctcactatataaagactcactaatactcatacaaactaaagacatgcaagaaccagaatttgtatattacaacgcatttacatcatccacagtcagcctaatagtatcaaaacacgacaacaaattcgagaccctcagcaaaaaccaaaaaattttatttaaaaacgcaaacgaaaaagaagtcatagccaaatccataggcatacaaaacctgaaagtgtttgaaaaatacatagtctcagcactaggagaagtcacaaaagcagaatttcgacaaagagaagaattcaaaaacgaactgcgatga

SEQ ID NO: 4878 - RNA, 2955 nt, synthetic construct
  misc_feature 1..2955: note = Cas9 variant
  source 1..2955: mol_type = other RNA
atggcacgaatactagccttcgacatcggaatatcatcaattggatgggcattctcagaaaatgacgaactaaaagactgcggcgtgagaatattcactaaagctgagaatccaaaaacaggagaaagtctagcattacccagaagactagccagatcagcaagaaaaagacttgcaagaagaaaagcaagattgaacagattaaaacatttaatagcaaacgaatttaaattaaactacgaagactatcagtcattcgacgaaagcctggctaaggcatataaaggatcactaattagcccttacgaactacgtttcagagccttgaacgagttactctcaaaacaagattttgcaagagtaatactacacatagcaaaaagaaggggatatgacgatataaaaaattcagacgacaaagaaaaaggcgccatccttaaagccatcaaacaaaatgaagaaaagctagcaaactaccaatcagtcggagaatacctctataaagaatacttccaaaaattcaaagagaactcaaaagagttcaccaatgtacgaaacaaaaaagaaagctacgaaagatgtatagcccagtcattcctcaaagacgaattaaagttaatattcaaaaaacaaagagaattcggatttagcttctctaaaaaatttgaagaagaagtcctaagcgtggccttctataaacgagcactaaaagatttctcacacctagtaggtaactgctccttctttactgacgaaaagagagcgccaaaaaactcgccgttagcattcatgttcgtagcattaacaagaatcatcaacctactgaacaacttaaaaaatacagaaggtatcctatacaccaaagatgacctaaacgccctactcaacgaatttttaaaaaacggcactctaacctataaacaaactaaaaaattactcggattaagtgatgactacgaattcaaaggagaaaagggaacttacttcatagaatttaaaaaatacaaagagttcataaaagcattaggcgaacataatctaagtcaagacgaccttaatgaaatagctaaggatataactctaatcaaagacgaaatcaaactcaaaaaagccttagctaaatatgaccttaaccaaaaccaaatagacagcttaagtaaattagaatttaaagaccatttaaatatatcctttaaggcactaaaattaataacaccccttatgctagaggggaaaaaatacgatgaagcgtgcaatgaacttaatctcaaagtagctataaatgaagataaaaaagatttcctaccagcattcaacgaaacatattataaagatgaagtaacaaacccagtagtattgagagcaataaaagaatatcgaaaagtcctaaacgcacttttaaaaaagtacggcaaagtacataaaatcaacattgaactcgccagagaagttggaaaaaactatagtcaaagagccaaaatagaaaaagaacaaaatgaaaactataaagctaaaaaagacgccgagcttgagtgtgagaaactcggactaaagataaattcaaagaacatattaaaattacgtttatttaaagaacaaaaagaattctgcgcgtatagcggcgaaaaaataaagatctctgatctacaagatgaaaaaatgttagaaatagaccatatatacccttacagtaggtccttcgacgacagctacatgaacaaagtgttagtatttacaaaacagaaccaagaaaaattaaatcaaaccccgttcgaagcctttggaaacgacagcgcaaaatggcaaaaaatagaagtcttagcaaaaaacctcccaactaaaaaacaaaaaagaatcctagataaaaattataaagacaaggaacaaaaagattttaaagacaggaacctaaacgatacaagatatatagcaagactagttctcaattataccaaagactatttagactttttaccgcttagtgacgatgaaaacaccaagttaaacgatactcataaaggatcgaaagttcacgtagaagccaaaagtggaatgttgacaagcgcgttaagacatacatggggcttttcaactaaagatcgaaataaccacttaagacatgcaatagacgcggtaataatagcatatgccaacaactctatagtcaaagccttcagtgattttaaaaaagagcaagaatcaaattccgcagaactatacgcgaaaaaaattagtgaattagactataaaaacaaaagaaaattttttgaaccgttttcaggatttagacaaaaagtacttgacaaaatcgacgaaatctttgtatcgaaacccgagagaaaaaaaccatccggggctctacatgaggaaactttcagaaaagaagaagagttctaccaatcttacggaggaaaagaaggagtactcaaagcactagaattaggaaaaatacgaaaagtcaacggaaaaatcgtaaaaaacggcgatatgtttagagtagacatctttaaacacaaaaaaaccaacaaattctatgccgtgcccatatacacaatggactttgctttaaaagtactaccaaacaaagccgttgctagaagcaaaaagggtgaaataaaagattggatcctaatggacgaaaactatgaattctgcttctctctatacaaagactctcttatcctaatacaaacaaaagacatgcaagaaccagagtttgtatactacaacgcattcacaagttcaacagtaagtctaatagtttcaaaacatgacaataaattcgaaaccctatcaaaaaaccaaaaaatacttttcaaaaacgcaaacgaaaaagaagtgattgcaaaatcaatcggaatacaaaacctcaaagtattcgaaaaatacattgtatcagctctcggagaagtaacaaaagccgaattcagacaaagggaagactttaaaaaatga

SEQ ID NO: 4879 - RNA, 2955 nt, synthetic construct
  misc_feature 1..2955: note = Cas9 variant
  source 1..2955: mol_type = other RNA
atggcacgaatactcgcgtttgatattggtattagctccattggatgggcattctcagaaaatgacgaactcaaagactgcggcgtcaggatcttcactaaagtagagaacccaaaaaccggagaaagccttgcactacctagacgactagcacgtagtgcaagaaaaagactcgcacggcgaaaagcaagactaaatcatctaaaacacttaatagcaaacgaatttaaattaaattatgaagactaccagtccttcgatgaatcactagccaaagcatacaaaggaagcctcataagtccctacgaactcagattccgggcattaaatgaacttctatcaaaacaagatttcgcacgagtcatattacacattgcaaaacgcagaggatatgacgacataaaaaattcagacgacaaagaaaaaggagcaatactaaaagcaatcaaacaaaatgaagaaaaactagcaaactaccaatcagtaggcgaatacctatataaagaatactttcaaaaattcaaggaaaacagcaaagaattcactaacgtacggaataaaaaagaatcatatgaaagatgtatagcacaatcatttctaaaagacgagctaaaacttatattcaaaaaacaacgagaatttggattctcatttagcaaaaaatttgaagaggaagtgctgtcagttgcattctataaaagagctctaaaagactttagccatttggtaggaaactgtagcttcttcaccgacgaaaaacgagcacctaaaaatagcccattagcgttcatgttcgtaactcttaccagaataataaacctcttaaataatctgaaaaatacagaaggaatactatacaccaaagacgacctaaatgctctactcaatgaagttttaaaaaacggaacgttaacatacaaacaaacaaaaaaactactaggactaagcgacgactacgaattcaaaggagaaaaaggaacatactttatcgaattcaaaaaatacaaagaatttataaaagcgcttggcgaacacaatctaagccaagatgaccttaacgaaatcgcaaaagatattacgctaattaaagacgaaataaaactaaaaaaagcattagcaaaatatgacctaaaccaaaatcaaatagattcacttagtaaactagagttcaaagatcacctaaacatttcattcaaagctctaaagctaataacaccattaatgctagaggggaaaaaatacgacgaagcatgcaatgaattgaacctcaaagtagccatcaacgaagacaaaaaagactttctaccagcattcaacgaaacctactacaaagacgaagtaaccaatcctgtagttctaagagcaataaaagaatacagaaaagtcctaaacgcgctcctaaaaaaatacggaaaagtacataaaattaacatagaattagcaagagaagtaggaaaaaatcactcacaacgagctaaaatcgaaaaagaacaaaacgaaaattacaaagccaaaaaagacgctgagttagaatgtgaaaaattaggtttaaaaataaattcaaaaaacatcttaaaactacgcctattcaaagaacagaaagagttttgcgcttactcgggagaaaaaatcaaaatcagtgacttacaagatgaaaaaatgttagaaattgatcacatatatccatattcccgtagttttgacgactcttacatgaacaaagtactagtgtttacaaaacaaaaccaggaaaaactaaataaaacaccattcgaagcattcggaaatgattccgcaaagtggcaaaaaattgaagtactagctaaaaatttacccacaaaaaaacaaaaacgcatactagacaaaaattataaagacaaagaacaaaaagattttaaagaccggaatctaaacgatacaagatacatcgcaagactagtactcaactacacaaaggattatcttgattttctacctctctcagatgacgaaaacacaaaattaaacgatacacaaaaaggatcaaaagtgcacgtagaagcaaaatctggcatgctaacatcagcattacgccatacctggggattttcaactaaggacagaaataaccacttacaccatgcaatagatgcagtcatcatagcttacgcgaataattcaatcgtcaaagcattctccgactttaaaaaagaacaagaaagtaactcagcagagctttacgcaaaaaaaatttcggaattagactacaaaaataaacgaaaatttttcgaaccattcagcggttttagacaaaaagtattagacaagatagatgaaatatttgtctcgaaaccagaacgaaaaaaaccaagtggagccttacatgaagaaactttccgaaaagaagaagaattctaccaaagttatggaggcaaagagggcgtcttaaaagcattagaattaggaaaaatacggaaagtaaatggaaaaatagtcaaaaacggcgatatgtttagagtagacatattcaaacacaaaaagacaaataaattttatgcagttccaatatacaccatggacttcgctctaaaagttttacccaataaagcggtagcaagatcaaaaaaaggagagataaaagattggatactaatggatgaaaattacgaattttgcttcagcctctacaaggacagtttaatactcatccaaaccaaagacatgcaagaaccagaattcgtttattacaatgcgtttacatcatcaacagtaagcctaattgtatcaaaacacgacaataaattcgaaacattatcaaaaaaccaaaaaatattatttaaaaacgcaaatgaaaaagaagtaatagctaaatcaatcggcatacaaaatttgaaagtattcgaaaaatatattgtatcagcacttggtgaagtaaccaaagccgaattcagacaaagggaagactttaagaaatga

SEQ ID NO: 4880 - RNA, 2955 nt, synthetic construct
  misc_feature 1..2955: note = Cas9 variant
  source 1..2955: mol_type = other RNA
atggcaagaatactagcgtttgacatcggaatatcatcaataggatgggcattctcggaaaatgacgaactaaaagactgtggagtaagaatatttacaaaagcggaaaaccccaaaactggtgaatcattagcacttcccagaagattagcaagaagtgctagaaaacgactagcacgaagaaaagcaagattaaatcacctaaaacatctaatcgcaaacgaattcaaactcaactatgaagactatcaatcatttgacgaatcactagccaaagcatacaaaggttcgttaataagcccctatgaactcagattcagagccctcaacgaactattaagtaaacaagacttcgctcgtgtaatactccacatagctaaaagaagaggatacgatgacattaagaactcagacgacaaagaaaaaggagctatactaaaagccataaaacagaacgaagaaaagctagcaaattaccaatcagtaggcgaatacctttacaaagaatacttccaaaaattcaaagaaaactccaaagaatttacgaacgtgagaaacaaaaaagaatcctacgaaagatgcatagcacaaagctttttaaaagacgaactaaaactaatatttaaaaagcaacgagaatttggattttcatttagcaaaaagttcgaagaagaagtactaagcgttgcattttacaaacgagcactcaaagacttttcacatctcgtcggcaattgttcgtttttcacagacgaaaagagagcacccaaaaactcaccactcgctttcatgtttgtagcgttaacaagaataataaatctcctaaataacctcaaaaacacggaaggtatattatatacaaaagacgatctcaacgccctactcaacgaagttcttaaaaatggtacactaacttacaaacaaacaaaaaagttactaggactaagcgacgattatgaattcaaaggcgaaaaaggtacatacttcatcgaattcaaaaaatacaaagaattcataaaagctttaggcgatcattcactatcacaggacgacctaaatgaaatagccaaagatataacgttaataaaagacgaaataaaactgaaaaaagcgctcgcaaaatatgaccttaaccaaaaccagatagacagcctcagtaaattagaattcaaagaccacttaaatatttcattcaaagccttaaaattaatcacaccattaatgctagaaggtaaaaaatatgacgaagcctgtaacgaactaaatttaaaagtggcaataaacgaagacaaaaaagacttcttacccgcatttaacgagacatattataaagacgaagttacaaacccagtagtactccgagctataaaagaatatagaaaaatattaaacgcactattaaaaaaatatggaaaagtacacaaaataaacatcgaattagcgagagaagtgggaaaaaaccatagtcaaagagcaaaaatcgaaaaagagcaaaacgaaaattataaagcaaaaaaagacgcagaaatagaatgtgaaaaactgggtttgaaaataaactccaaaaacatactaaaattaagattattcaaagagcaaaaagaattctgcgcatattcaggcgaaaaaataaaattaagcgatcttcaagatgaaaaaatgctcgaaatagaccacatctacccttacagtagatcattcgacgacagttatatgaacaaagttctagtatttaccaaacaaaaccaagaaaaactaaacaagacaccatttgaagccttcggaaatgacagcacaaaatggcaaaaaatagaggtcttggccaaaaacctaccagaaaaaaaacaaaagcgtatactagacaaaaattacaaggacaaagagcaaaaagatttcaaagatagaaatttaaatgatacaagatacatagcaagattagtacttaactacacaaaggactatctagactttctgccacttagcgacgacgaaaacaccaaactgaatgatacacaaaaaggttcaaaagtgcacgtagaagcaaaatcgggcatgttaacatcagcactcagacacacctggggcttttccgcaaaagacaggaataatcacttacaccatgcaatagatgcagctatcatcgcctatgcaaataactccatcgtaaaagcatttagcgatttcaaaaaagaacaagaaagtaattcggtagaactttacgcaaaaaagatatcagaactagattataaaaacaaaagaaaattcttcgaacccttctcaggctttagacaaaaagtactcgacaaaatagacgaaatctttgtatcaaagccagaacgaaaaaaaccaagtggagctttacatgaagaaacattcagaaaagaggaagaattctaccaaagttacggcggaaaagaaggcgtattaaaagcactagaattaggaaaaattcgaaaagtaaatggcaaaatagtaaaaaacggtgacatgtttagagtagatatctttaaacacaaaaagacaaacaaattctacgcagtaccaatttacacgatggacttcgcattaaaagtactaccaaataaggcagtcgcccgctcaaaaaaaggcgaaataaaagactggatcttaatggacgaaaactatgaattctgtttctcattatacaaagactccctgatactcatacaaacaaaagacatgcaggaaccagagcttgtctacttcaacgcttttacttcctccaccgttagcctaatcgtatctaaacacgacaacaaattcgaaacactgagtaaaaaccaaaaaatactgttcaaaaatgccaacgaaaaagaggtcatagctaaatcaataggtatacaaaatcttaaagtgtttgaaaaatacatagtctcagcgttaggagaagtcacaaaagcagaattcagacaaagagaagactttaaaaaatga

SEQ ID NO: 4881 - RNA, 2955 nt, synthetic construct
  misc_feature 1..2955: note = Cas9 variant
  source 1..2955: mol_type = other RNA
atggcaaggatactggccttcgacataggtatctcgtctataggatgggccttttcagaaaatgatgaactaaaagactgcggagtaagaatatttaccaaagtagaaaatcccaaaacaggagagtcactagccttaccacgacgtcttgcgagaagcgcaagaaaaagattagcgaggaggaaagcacgactaaatcaccttaaacatttaatagctaacgaatttaaattaaactacgaagactaccaaagttttgatgaaagtttggctaaagcctacaaaggaagcctcatcagtccctacgaactaagatttagagccctgaatgaactccttagtaaacaagactttgcacgagtaatattacacatagcaaaacgtagaggttatgatgacataaaaaacagcgatgacaaagaaaaaggagccatactgaaagcgataaaacaaaacgaagaaaaattagcaaactatcagtcggtcggtgaatacctctacaaagaatattttcaaaaattcaaagaaaatagcaaagaattcaccaatgtaagaaacaaaaaagaaagctacgaacgatgcatcgcacaaagcttcctaaaagatgaattaaagctaatattcaagaaacaaagagaattcggattttccttcagcaaaaaattcgaagaagaagtactatcagtcgctttctacaaacgagcactaaaagacttcagccatttagtaggaaactgtagcttcttcacagatgaaaaacgggcaccaaaaaacagccccctagccttcatgtttgttgcgctaacacgaataataaatctcttaaacaatctcaaaaacacagaaggaatactatatacaaaagatgaccttaatgcattactgaacgaagtcttaaaaaacggtacacttacttataaacaaactaaaaaactactcggcctaagtgacgactatgaattcaaaggagaaaagggcacatactttatagaattcaaaaaatataaagaatttataaaagcattaggcgaacataatctatcccaagacgatctcaacgaaatagctaaagatatcactttaataaaagatgaaataaaattaaaaaaagccttagcaaaatatgacctaaaccaaaatcaaatagattcactatctaaattagaatttaaggaccatttaaatatctcatttaaagccctaaaactaataacacccctaatgctagaaggcaaaaagtatgacgaagcctgcaacgaactaaatctaaaagtagcaataaatgaagataaaaaagattttctcccagcattcaacgaaacgtactacaaagacgaagtaacaaacccagtagtcctaagagccataaaagagtatagaaaagtattaaacgcactactcaaaaaatatggaaaggtgcataaaataaacatagaacttgcccgtgaagtaggaaaaaatcattctcaaagagcaaaaattgaaaaagaacaaaacgaaaactataaggcaaaaaaagacgccgaacttgaatgtgaaaagctaggccttaaaataaattcaaaaaacatattaaaactcagactattcaaagaacaaaaagaattttgcgcatacagtggagaaaaaatcaaaataagtgatctccaggacgaaaaaatgctggaaatagaccacatctacccctacagcagaagttttgacgactcttacatgaataaggttctagtatttacaaaacaaaaccaagagaaattaaacaaaacaccatttgaagcattcggcaacgactcagcgaaatggcaaaaaatagaggttctagcaaagaacctgccaacaaaaaaacaaaaacgtatcttagacaaaaattacaaagataaagaacaaaaagacttcaaagacagaaatctcaacgacacccgatacatagcaagactagtgctaaattacaccaaagactatttagacttcttaccactctcagacgacgaaaacacaaaactaaatgacacacaaaaaggctcaaaagtccacgtagaagcaaaatcaggaatgctaacttcggccctaaggcatacatggggattctcaactaaagacagaaacaaccacttgcaccatgccattgacgcagtaataatcgcatacgcaaacaactccatcgttaaagctttcagcgatttcaaaaaagaacaagaatctaactcagcggaactatacgcaaaaaaaatctcggaactagactataagaacaaacgaaaattcttcgaaccattcagcggcttcaggcaaaaagtactcgacaagatcgacgaaatcttcgtttcaaagccagaacgtaaaaaaccgagcggagccttacacgaagaaacattcagaaaagaagaagaattttaccaatcatacggaggcaaagaaggagttttgaaagcactggaacttggtaaaatacgaaaagtaaacggcaagatagtaaaaaacggagatatgtttagagtggatatattcaaacataaaaaaacaaataaattctacgcagtaccaatctatacaatggactttgccttaaaagttctacctaataaagcggtcgctcggtcaaagaaaggagaaataaaagactggattttaatggacgaaaactacgaattttgtttttcactctacaaagacagtctaatattaattcaaaccaaagatatgcaagaaccggaatttgtatactacaacgcttttacaagtagcaccgtatccctcattgtatcaaaacatgacaacaaatttgaaaccctatccaaaaaccaaaaaatactattcaaaaacgcaaatgaaaaagaagtcatagcaaaatcaataggaatacaaaacctaaaagtatttgaaaagtatatagtatctgcgctcggtgaggtcactaaagcagaattccgccaaagagaagactttaaaaaatga

SEQ ID NO: 4882 - RNA, 2955 nt, synthetic construct
  misc_feature 1..2955: note = Cas9 variant
  source 1..2955: mol_type = other RNA
atggcccgcatattagcatttgatataggtatatcctcaatcggatgggccttcagtgaaaacgacgaactaaaagactgcggagtaagaatttttacaaaagcagaaaacccaaagacaggcgaaagcctcgcgttacccagaagattagcacgctcagcaagaaagagactcgcccgaagaaaagctcgactaaaccacttaaaacatcttatagctaatgaattcaaactcaactatgaagattaccaatccttcgacgaatcactcgccaaggcatacaaaggcagtttaattagtccctacgaattacgtttccgcgcactaaatgaactcctctccaaacaagattttgctcgggtgatactacatatcgccaaacgaagagggtacgacgatataaaaaactcagacgacaaggaaaaaggagcaatactaaaagcaataaaacaaaatgaagaaaaattagcaaattatcaatcagttggagaatacctatacaaagaatactttcaaaaattcaaagaaaattctaaagaattcacaaacgtaagaaacaaaaaagaatcctatgaaagatgcatagcacaatcattcctaaaagatgagcttaaattaatctttaaaaaacaacgtgaatttggattttcattctcaaaaaaatttgaagaagaagtcttatcagtagcattctacaaaagggctcttaaagatttctcacacctagtaggaaactgctcctttttcacagatgaaaaacgagcccctaaaaacagtccactagcatttatgtttgtagcactaactagaataatcaacctactcaataaccttaaaaatacagaagggattctctatacaaaagatgatttaaacgccctattaaacgaggtcctaaaaaacggtactttaacatataaacaaacgaagaaacttctaggcctaagtgacgactatgaatttaaaggagaaaaaggtacatactttatagaatttaagaaatataaagaatttataaaagcactaggagaccatagcctatcccaagatgacctaaatgaaatagccaaggatatcaccctaataaaagacgaaatcaagttaaaaaaagccctagccaaatatgacctaaatcaaaatcaaatagattcactaagcaaactcgaattcaaagatcaccttaatatatccttcaaagcattaaaattaatcactcctttaatgcttgagggaaaaaaatacgatgaagcctgtaacgaattaaatttaaaagtagctatcaatgaagataaaaaagattttctgcccgcattcaacgaaacttattataaagatgaggtgacaaaccccgtggtactccgagccataaaagaataccgcaaagtcctaaatgcactcctaaaaaaatacggaaaggtacacaaaattaacatagaactagcaagagaagtaggaaaaaactatagtcaaagagcaaaaatagaaaaagaacaaaatgaaaactacaaagccaaaaaagacgcagaactagaatgtgaaaaattaggattaaaaataaactcaaaaaatatattaaaacttcgactatttaaagaacaaaaagagttttgtgcctattcaggagaaaaaataaaaatatctgacttacaagacgaaaaaatgctggaaatagaccacatatacccctacagtcgaagtttcgatgatttttacatgaataaagttctagttttcacaaaacaaaaccaagaaaagttaaatcaaacacccttcgaagcatttggaaacgatagtgcaaaatggcagaaaatagaggtcctagccaaaaacttacccactaaaaaacaaaaacgaatactagacaaaaactacaaagacaaagagcaaaaagattttaaagacaggaacctaaacgatacaagatatatagctcggcttgtgctaaattacacaaaagattacctagacttcttaccattatcggacgacgaaaataccaaactaaacgatacccaaaaaggttcaaaagttcacgttgaagcaaaaagtggaatgttaacatctgccctcaggcatacatgggggtttagcgcaaaagaccgaaacaaccacctacaccatgcaatcgacgcggttataatagcatatgcaaacaattcaattgtcaaagcattttccgactttaaaaaagaacaagaatcaaacagtgccgaactatatgcaaaaaaaatttcagaactagactataaaaacaaaagaaaattcttcgaaccctttagcggatttagacaaaaagtcttagataaaatagacgaaatatttgtctcgaaaccagaaagaaagaagccttccggagcgctacatgaagaaacatttaggaaagaggaggaattctaccaatcatatggcggaaaagaaggcgttctaaaagcactcgaactaggaaaaatacgaaaagtaaatggaaaaatagtcaaaaatggtgacatgtttcgcgtagacatattcaaacacaaaaagaccaataaattttacgcagttccaatatacacgatggatttcgcactgaaagtattaccaaataaagcagtagcacgaagtaaaaaaggtgaaataaaagattggatattgatggatgaaaactatgaattctgcttttcactctacaaagactcactaatactaatacaaacaaaagatatgcaggaacccgaattcgtctactacaatgcatttacatcatcaactgtatcattaatcgtatcaaaacacgacaataaattcgaaacactaagcaaaaaccagaaaatactattcaagaatgcgaacgagaaagaagttatagcaaagtcaattgggattcaaaacttaaaagtattcgaaaaatacatagtaagcgccctcggagaagtaacaaaagcagaattcagacagcgcgaagattttaaaaaatga

SEQ ID NO: 4883 - RNA, 2955 nt, synthetic construct
  misc_feature 1..2955: note = Cas9 variant
  source 1..2955: mol_type = other RNA
atggcaagaatacttgcctttgatataggcataagttctataggctgggctttctcagaaaacgatgaactaaaggattgcggagtgaggatattcaccaaagctgaaaatcccaaaacaggagaatcattagcacttccaagacgacttgctagaagcgcaaggaaacgattagcaagaagaaaagcaagactcaaccatctgaaacacctaattgcaaatgaatttaaactcaattacgaagactaccaatcttttgatgaaagcctagccaaagcatacaaaggatcgcttataagcccatacgaactacgattcagagctttaaatgaattactatcaaaacaagactttgcacgcgtaatattacacatcgcaaaaagacgaggatatgatgatattaaaaactcagacgacaaggaaaaaggagcaatcctcaaagctatcaaacaaaacgaagaaaaactagccaactatcaaagcgtcggtgaatacttatacaaagaatattttcaaaaattcaaggagaattctaaagaattcacaaatgtacgaaataaaaaagaatcctatgaaagatgcattgcacaaagttttctcaaagacgagctgaaactaatatttaagaagcaaagagaattcggattttcattctccaaaaaatttgaagaagaagtactaagcgtcgccttttataaacgggctctaaaagactttagccatcttgtcggaaactgcagctttttcacagatgaaaagagagcacccaaaaattcaccactagccttcatgtttgttgctcttactagaataataaacctactaaacaatctaaaaaacacagaaggaatattgtacacaaaagatgaccttaatgcccttctaaatgaattcttaaaaaatggcacattaacctataaacaaaccaaaaaactattaggcctcagcgacgattacgaatttaaaggagaaaaaggaacgtactttatagaattcaaaaaatacaaagaattcataaaagcgctaggagaacataacttaagtcaagacgacttaaatgaaatagccaaagatataacactgataaaagatgaaatcaaattaaaaaaagctctagcaaaatacgacctcaaccagaaccaaattgactccttgtcaaagctcgaatttaaggatcaccttaacattagctttaaagcattaaaactaatcacaccccttatgttagaaggcaaaaaatacgatgaagcatgcaatgaattaaatttaaaaattgcaataaacgaagacaaaaaagacttccttccagccttcaacgagacgtactacaaagacgaagtcacaaacccagtagtattacgagcaataaaggaatacaggaaagtactgaatgccttactaaaaaagtacggcaaagttcacaaaataaacatagaactcgctcgtgaagtgggaaaaaaccacagtcaaagagcaaagatagaaaaagaacaaaacgaaaactacaaggcaaaaaaagatgctgaacttgaatgcgaaaaattaggactaaaaatcaattcaaaaaatattctaaaactacgcttattcaaggaacaaaaagaattctgcgcatattcaggagaaaaaataaaaatttcagacttgcaagatgaaaaaatgctagaaatagaccatatatatccctacagtcgttcctttgacgattcctatatgaataaagtgctcgtcttcactaaacaaaaccaagaaaaactaaaccaaaccccattcgaagcatttggaaatgacagcgccaaatggcaaaaaatcgaagttctcgctaaaaacttaccaacaaaaaagcaaaagcgaatactagacaaaaactacaaagataaagaacaaaaaaactttaaagataggaatcttaacgatacaagatacattgcaagacttgtactcaattacacaaaagattatctagatttcttaccattaagcgacgatgaaaatacaaaactaaatgacacccagaaaggatcaaaggtccatgtagaagccaaatcaggaatgttaacaagtgcactacgacacacatggggcttcagtgcgaaagacagaaacaatcacttacaccatgccatcgacgcagtaattatagcttacgcaaacaactccatagttaaagcattttcagactttaaaaaagaacaagagagcaactcagctgaattatacgccaaaaaaatcagcgaactagactataaaaacaaacgaaaattcttcgaaccatttagcggattccgccaaaaagttttagacaaaatagatgagatattcgtaagcaaacccgaacgaaaaaagccaagtggtgcattacacgaagaaacctttaggaaagaagaagaattctatcaatcatatggtggcaaggaaggcgtattaaaagcactagaattgggtaaaatcagaaaagtaaacggaaaaatcgttaaaaatggcgacatgttcagagtagatatcttcaaacacaagaaaacaaacaaattttacgcagtaccaatatataccatggatttcgcactaaaagttctacctaataaagcagtcgccagatcgaaaaagggagaaatcaaagactggatacttatggacgaaaactacgaattctgcttcagcctatacaaagacagtctaatactaatacagacgaaagacatgcaagaaccagaatttgtatactacaacgcatttacaagctcaacagtatctttaatcgtttcaaaacacgacaacaaattcgaaactttaagcaaaaaccagaagatcctttttaaaaatgctaatgaaaaggaagtaattgcaaaatcaataggcatacaaaacctaaaagtatttgaaaaatatatagtcagcgccttaggagaagtaactaaagcagagttccgacaacgtgaagactttaaaaaatga

SEQ ID NO: 4884 - RNA, 2955 nt, synthetic construct
  misc_feature 1..2955: note = Cas9 variant
  source 1..2955: mol_type = other RNA
atggttagaatcttagcattcgacatcggcatctcaagtataggttgggcatttagcgaaaacgatgaacttaaagactgcggagtccgaatatttacaaaagtagaaaaccctaaaacaggagaatccttggcgttgccaagaagactagcaagatcagctagaaaaaggctcgcacgccgcaaagctagattaaatcacttgaaacatctaatagcaaacgaatttaaacttaactacgaagactatcaatcattcgacgaatcattagccaaagcatacaaaggatcattaatctcaccatacgaattaagattcagagcactaaacgaactcttatcaaaacaagatttcgcacgcgtcatacttcacatcgcaaaaagaagaggatatgacgacatcaaaaattcagatgacaaagaaaaaggagcaatcctaaaagccatcaaacaaaatgaagaaaaactagccaactaccaatcagttggagaatatctatacaaagaatatttccaaaaattcaaagaaaattccaaggagttcaccaacgtcagaaataagaaagaatcatatgaacgctgtattgcccaatcattcttaaaagatgaactaaaattaatttttaagaaacaaagagaatttggattcagtttcagtaagaaattcgaagaagaagtactatccgtagcattctacaaaagagcactaaaagactttagccacttagtaggaaactgttcattcttcacagatgagaaaagagcacctaaaaactctccactagcctttatgtttgtagccctaaccagaatcattaatttattaaataacctgaaaaatacggaaggtatcctatacaccaaagacgatttaaacgctctactgaacgaagtactcaaaaacggaacactaacgtacaaacaaacaaagaaactactaggactctcagacgattatgagttcaaaggagaaaaaggaacatattttatcgagttcaagaaatataaagagttcataaaagcactcggcgaacataacctttcacaagacgacctcaacgaaatcgcaaaagatataacactgataaaagacgaaataaaactaaagaaagcattagcaaaatacgacctaaaccaaaatcaaatcgactccttgtccaaacttgaatttaaagaccacctaaacatttcattcaaggccctgaaactaattacacccctcatgttggaaggtaagaaatacgatgaagcatgcaacgaactcaacctaaaagtagcaataaatgaagataagaaagacttccttcctgccttcaacgaaacgtactacaaagacgaagtaacaaatccagtagtactaagagcaataaaagaatacagaaaagtcctcaacgcactactaaagaaatatggaaaagtacacaaaataaatattgaactcgcaagagaagtaggtaaaaaccattcgcaaagagccaaaatagaaaaagaacaaaacgaaaactacaaagctaagaaagacgcagaactagaatgcgaaaaactcggattaaaaataaattctaaaaacatcctaaaactacgactattcaaagaacagaaagagttctgcgcttattcaggagagaaaattaaaatctcagatctacaagatgagaaaatgctagaaatagatcacatatacccttactcacgctcattcgacgactcttacatgaacaaagtgctcgtcttcacaaaacaaaaccaagaaaaactcaacaaaactccatttgaggctttcggaaatgactcagcaaaatggcagaaaatagaagtactagctaaaaacttaccaactaagaaacaaaaacgaatcctagataaaaactataaagacaaagaacaaaaagacttcaaagacagaaatctaaatgacacgagatacatagcacgtctggtactgaattacacaaaagattatctggacttcctaccactcagcgatgacgaaaacacaaaattgaacgatacacaaaaaggatctaaagtacatgtagaagcaaaatcaggaatgctaacctcagcactaagacacacatggggattctcaactaaagacagaaacaatcatctacaccacgcaatagacgcagtgattatcgcatatgcaaataattcaatagtgaaagccttcagcgacttcaagaaagaacaagaaagtaactctgcagaactctacgctaagaaaatatcagaactcgattataaaaacaaaaggaaattcttcgaaccattctccgggttcagacaaaaagtactagacaaaattgacgaaatattcgtaagcaaaccagaaagaaagaaaccaagcggagcacttcatgaagaaacatttagaaaagaagaagagttctatcaatcatacggaggaaaagaaggagtactaaaagcattagaactcggaaaaatacgaaaagtaaacggaaaaatagtcaaaaacggcgatatgtttagagtagacatattcaaacacaagaaaaccaacaaattctacgcagtacccatctataccatggacttcgcgttgaaagtattacccaataaagcagtagcaaggagcaagaaaggagaaataaaagattggatactaatggatgaaaattatgaattttgcttctcattatacaaagattctttaatattaatacaaacaaaagacatgcaggaaccagagttcgtatattataatgcattcacatcttcaactgtaagcctaatcgtctccaaacacgataacaaattcgaaactctcagcaaaaatcagaaaatactgttcaaaaacgcaaacgaaaaagaagtaatagctaaatcaataggaatacaaaatctaaaagtattcgaaaaatacattgtatcagctttaggagaagtaaccaaagctgaatttagacaaagagaagacttcaagaaatga

SEQ ID NO: 4885 - RNA, 2955 nt, synthetic construct
  misc_feature 1..2955: note = Cas9 variant
  source 1..2955: mol_type = other RNA
atggccaggatattagctttcgatataggcataagcagcatcggatgggcgtttagtgagaatgatgagctcaaagactgtggcgtgcgcatattcacaaaagcagaaaaccctaaaaccggcgaaagcttagccctaccaagacggcttgctagaagcgccagaaaaagattagctagacgaaaagcaagactaaaccatctaaaacacttaatagccaacgaatttaaattaaattacgaagattaccaatcattcgatgaatcgctagcaaaagcgtataaaggatcgttaataagcccatatgaacttcgattccgagcacttaatgaattattatcaaaacaagactttgccagagtaatattgcatatagcaaaaagaagaggatatgatgacataaaaaatagcgatgacaaagaaaaaggagctatcctaaaagcaataaaacagaatgaagaaaagctagcaaactaccaatccgtaggagaatatctttacaaagagtacttccaaaaatttaaagaaaattctaaagaattcacaaacgtgagaaataaaaaagaatcatatgaacgatgtatagctcaatcattcttaaaagatgaactaaaacttatcttcaaaaaacaacgagaatttggattttcgttctcaaaaaaattcgaagaagaagttttatcagtcgccttctacaaacgtgctttaaaggatttttcacatcttgtaggcaactgttctttcttcacagacgaaaagcgcgccccaaagaatagtccacttgcgttcatgttcgtcgcgctcacaagaatcataaacctccttaataacttgaaaaacacagaaggcattttatacacgaaagatgacttaaacgcacttctaaacgaagtcctaaaaaacgggactctcacttacaaacaaaccaaaaaactcctaggactgtctgacgattacgaattcaaaggtgaaaaaggaacctactttatagaattcaaaaaatacaaagaatttataaaagccctaggcgatcactccttatcgcaagacgatctaaatgaaatagccaaagatattaccctaataaaggatgaaattaaactaaaaaaagcattagcaaagtatgatcttaatcaaaaccaaattgactcactatcaaaactagaatttaaggatcacctaaatatatcgttcaaagcattaaaacttatcaccccattaatgttggaaggaaaaaaatacgacgaagcgtgcaacgaattaaatttaaaagtagcaataaacgaggataaaaaggacttcctacccgcattcaacgaaacatactacaaagatgaagtgacaaatcctgtagtattacgagctataaaagaatatagaaaagtccttaacgcgctactaaaaaaatatggcaaagtacataaaataaacatcgaattagcaagggaagttggcaaaaactattctcaaagggcaaaaattgaaaaagaacaaaacgaaaactacaaggcaaaaaaggacgcagaacttgaatgcgaaaaactcggcctaaaaattaattctaaaaacatccttaaactaagacttttcaaagaacaaaaagaattttgtgcatactcaggtgagaaaatcaaaatatcagacctacaagatgaaaaaatgttagaaatagatcatatttacccgtattcaagatcattcgacgattcatacatgaataaagtattagtcttcacaaaacaaaaccaagaaaaactaaatcaaactccattcgaagcatttggaaatgacagcgcaaaatggcagaaaatagaagtattagctaaaaatttaccaacaaaaaaacaaaaaagaattttagataaaaattataaagataaggaacaaaaagactttaaagacagaaacctaaacgacacccggtacatagcacgattagtactcaattacactaaagactacctagactttctcccactatcagacgatgaaaatacaaaactaaatgacactcaaaaaggatcaaaagtccacgtagaagcaaaatcaggaatgctcacatcagcactgcgtcatacctggggcttctcggcaaaagaccgaaacaaccatctacaccacgcaattgatgcagtaataatcgcatatgcaaataactccatcgtcaaagcattcagcgacttcaaaaaagaacaggaatccaatagcgcagaactatatgccaaaaaaatatccgaattagactacaaaaacaaacgaaaattcttcgaacccttctcaggatttagacaaaaggtactagataaaatagatgaaatattcgtaagtaaaccagagcgcaaaaaaccaagcggtgcactacacgaagaaacctttcgaaaagaggaagagttctatcaaagctatggaggaaaagaaggcgtacttaaagcgttagaactaggtaaaatacgaaaggtaaacggaaaaatagttaaaaacggcgacatgtttcgagtagacatatttaaacataaaaaaacaaacaaattctatgcagtaccaatctacacaatggattttgcgttaaaagtattaccaaacaaagcggtagcacgatccaaaaaaggcgagatcaaagactggatattaatggacgaaaattacgaattctgtttcagcttatataaagactccttaattttaatacagaccaaagacatgcaagaaccagaatttgtatattataacgcttttacatcatccactgtttcattaatagtatctaaacatgacaataaatttgaaaccctatcaaaaaatcaaaaaattttattcaaaaacgcaaatgaaaaagaagtaatcgcaaaatcgatcggtatccagaacttaaaagtattcgaaaaatacatcgtatccgccctaggtgaagttacaaaagccgaattcagacaaagggaagacttcaaaaaatga

SEQ ID NO: 4886 - RNA, 2958 nt, synthetic construct
  misc_feature 1..2958: note = Cas9 variant
  source 1..2958: mol_type = other RNA
atggcaaaaatactagcgtttgacattggaatatcgtcaataggatgggccttcgtagaaaatgatgagctcaaagactgcggagtccgaatctttactaaggcagaaaaccccaaaacaggggaaagtttagcactaccccgaagacttgcccgctcagctagaaagagactagcgcgaagaaaagctagactcaatcacctcaaacacctgatagcaaatgaattcaaacttaactacgaagactaccaatcttttgacgaatcactcgcaaaagcatataaagggacactaataagtccatatgaactacgattcaaagcattaaacgaattattatcaaaacaagacctagcaagagtaatcttacatatagcaaaaagaagaggatacgataacataaaaaactccgacgacaaagaaaaaggagcaattctcaaagcagtaaaagaaaacgaagaaaagctagccaattataaatccgtaggagaatatctatacaaagagtatttccaaaaatttaaagaaaatagcaaagaattcataaacgttcgtaacaaaaaagaaagctacgaaagatgcatagcacaatccttcctaaaagacgaattaaaattaatattccaaaaacaaagagaattcggctttaacttcagtaaaaaatttgaagaagaagtattaagcgtagcattctataaacgagcattaaaagacttctcacaccttgtaggtaattgttcttttttcgtagacgaaaaacgcgcgccaaaaaattcaccactagccttcgaatttgttgcactaacacgaatagtaaatctactcaataacctcaacaaaaataattcatacataaaagacgacttaaacgcacttctatcagaggtcctcaaaaacggcacactaacatacaagcaaactaaaaaaatcctaggattatcagacgactacgaatttaaaggccaaaaaggcaattactttatcgaatttaaaaaatacaaagaattcataaaagccttatgcgaacataatttaaatcaagacgatctaaatgaaatagctaaagacataactctggtcaaagacgaaacaaaattaaaaaaagccttggcgaaatacgacttaaaccaaaaccaaatagaaaatctttctaaaatagaattcaaagaccatttaaatataagtttcaaagcactaaaattaatcgtaccactgatgcgagaaggaaaaaaatatgatgaagtttgcaacgaactcaacctcaaaacagcaatcaatgaagataaaaaagagtttttaccagcttttaatgaaacatattacaaagacgaagtgaataacccggtcgtactacgagctatcaaggaatacagaaaagtcctaaactccttactgaaaaaatacggcaaagtacacaaaataaatatagagctagccagagaagttggaaaaaatcacagagaacgttcaaaaatagaaaaagaacaaaatgaaaattttaaagcaaaaaaagacgcagaactggaatgcgaaaaattaggtctaaaaataaacagtaaaaatatcttaaaattacgcttattcaaagaacaaaaagaattctgcgtctacagcggagaaaaaataaaaatctcagaccttcaagacgaaaaaatgctagaaatagaccacatctacccttatagcagatcattcgacgatagctacatgaacaaagtactagtctttactaaacagaatcaagagaaactaaacaaaacaccattcgaggcattcggaaaagacgatgtaaagtggcaaaaaatcgaaactctagccaaaaacttgccagcgaaaaaacaaaagcgaatcctagacaaaaactacaaagacaaggaacaaaaagatttcaaagacaggaacctcaatgacacccgatatatagcacgactagtactgaactacactaaagattatctagaatttctaccattatcagatgacgaaaatataaaactcaacgacacacaaaaaggatccaaagtacatgtcgaagcaaaatcgggaatgttaacatcagtactaagacacacatggggattctcgacaaaggacagaaacaatcacctacaccatgccatagacgcagtaataatagcctacgcaaatgcaagtgtagtaaaagccttctcagatttcaagaaagaacaagaaaattacacagcagaattatacgcaaaaaaaatcaacgaactcgacttcaaaaataaaaggaaattttttgagcccttctcaaacttcagacaaaaagtactagaaaaaatagatgaaatattcgtaagtaaacctgaaagaaaaaaaccctccggcgcattacatgaagaaacattctacaaagaagaagaattctacaaagagtatggaggaaaagaaggggtattaaaagcactagagctaggaaaaatacgaaaagtcaacggcaaaatcgttagtaacgctaacatgtttagagtagatattttcaaatataaaaagacgaacaaattctatgcagtacccatttacacaatggactttgcactcggcattttaccaaacaaagcagtagtcggaggtaaagacaaacaaggaataataaaagattggcttttaatggacgaaaattatgaattttgcttttcactatacaaagatagcctaatcttgttacagaccaaggacatgcaagagccagaactagtctacttcaaatcattcaaaagttctacagcaggactagtagtatcaaaacacgacaacaaattcgagaatttaaatgaaaaccaaaaaaagctatttaagtcagctaacgaaaaaaaagtcgtcgcagagggaataggaatacaaaacttaaaagttttcgagaaatacatagtatccgcactcggtgaaataacaaaggcagaaataaaagaaagagaaaacttcaaaaaaaaatga

SEQ ID NO: 4887 - RNA, 2961 nt, synthetic construct
  misc_feature 1..2961: note = Cas9 variant
  source 1..2961: mol_type = other RNA
atgccaagcgatccagcagaagccaaaccattagaattattggatccatatgccttgagggcacaaggactagaccaagcattgcccctcacacactttggtagagccctcttccatctaaatcaacgaagaggtttcaaaagtaatcgaaagacagatcgaggcgataacgaaaatggaaaaatcaaagatgcgtcacaacgtttagactgggcaatgcatgaagcaaaagcaagaacatatggagagtttttacatctaaggagacaaaaagcaccagaccctagacaagttccaacagtacgtacaaggctctcagtcggtaaaagaggaggaccagatgcaaaagaagaagctggatatgacttttacccagatagaaggcatttggaagaagaatttcatgaactatggtccgcacaagcacaatttcatcccgaactcacacaggacctacgcgacttggtattcgaaaagatattttatcagcgtcctcttaaagaacctaaagtcggtttatgtttattcacttcagaagaaagattagcgaaagcccatccattaacacaacgacgagttttgtacgaaacagtaaatcaattaaggataacagctgatggaagaagcgttaggccactaagtagggaacaaagagatcaaattatcttggcactagacacaaagaaacctacaaaatcacttaactcaatggtagtaacactgcaagcccttggaaaagtacttaaattacgagaaggagaaaggttcactctagaatcaggcgtaagagaggctatagcatgcgacccagtgcgggcagcaatgcttgcaacattcggtccaagatggtcagcacttgattggccagaacaatggcaagttatatcaagagtgagaaaactacaagatgacaaagattttgctgagctagtcgaatggttaatagaattgtacggagtagacaaagaagcagccgtaaaaatcgcaaatacccacttaccagaaggatatggaagactaggactgacggcaacgacaaggatattggatcggctaaaatcaaatgtatttacatacgcacaagcagtagctgcatgtggatggcatcattccgaccagagaacaggagaatgcctagatagactaccgtactatggagcagttttagatagacacgtcataccaggcacatatgacgaaaatgatgatgacatcacaagatttggaagaataacaaatccaactgttcatatcggactaaatcaactccgaaggctagttaataaaattatagaagtttacggcaaaccaaaccaaatagtagtagaacttgcacgagaattaaaacaaagtgaacaacagaaaaacgacgcaataaaattaataagagacacaacaacagcagcaaaacaaagatcagaaaaattagaagaattgggaataacagacaacggtagaaatagaatgttactaagactatgggaagacctaaacccagacgatgcaatgagaagattctgcccatacaccggacaaaggatatccgcagcaatgatcttcgatggatcttgcgatgtagatcatatactaccttattcaaggactctagatgatggtttcgcaaatagaacactatgtctaagggaggcaaaccgagaaaaacgtaaccaaactccatgggaagcatggggaggaactccgaattgggaagcaatagaaacaaatctaaagaatttacctgaaaataaaagatggagatttgcgccagatgcaatggcaaggtttgaaggagaaaacgacttcctcgatagagctctggtagacacgcagtacctagcaagaataagtagaacatatctagataccctattcacagaaggtggccacgtgtgggtagtaccaggacgcttgacagaaatgcttagaagacactggggccttaactctttgctaacagataaagatagaggtgccgtaaaaagcaaaaaccgaacagaccataggcaccatagtatagatgcagcagtagtagctgcgactgacagaagtttacttaatagaatatcgcgagcagccggtcaaggagaagtagcaggacagagtgcagaattaattgcaagggagactccaccaccttgggaaggtttccgaaatgatctaaaaagtcaactaggaagaattattgtaagtcacagagcagatcatggacggatagacagacaagcaagaaaacaaggacgggactctacagccggtcaactacatcaagaaacagcgtactccatagttgatgatacaagagtagcaagcagaatcgactttttaagtgtaaaaccagcacagttacttgaccaaccaggtagatcaggacaggtaagggatctacaattaagaaaagcgttacgagtagctacaggcgacctgaccggaaaagactacgagaaagcactaagggatttcgctgcaaaaccaggtccatataaaggtataaggagagtacgaataataaaacccttgcaagaacaagcgcgagtgcccgtcccagttcttgaccccataaaagcataccagggaggatcaaaccatgtattcgaaatatggcatttaccagacggcaaggtagaaccacaagtgataacctcatttgaagcacatgcgttagaagtggaaaagcgtccacaccctgcagctaaaagactattaagagtacataaaggcgatatggtagcactaaaacgtgaaggaagaacagtagtaggacacgttcaacagatgcatattaaaaatggtttattcatagttccgcataatgaagctaatgccgatgccagaaattctgacaggacagacccttttaaatggattcaaattgctgctcagccagcaatagcagcaggtatacgtcgtgtggcagtggacgaaatagggaggttaagagatggcggagcaaaaacaatatga

SEQ ID NO: 4888 - RNA, 2964 nt, synthetic construct
  misc_feature 1..2964: note = Cas9 variant
  source 1..2964: mol_type = other RNA
atggcaagaattctagcatttgacataggaatctcatccataggctgggcgttctctgaaaatgacgagctcaaagattgtggtgttagaatattcacaaaagcagaaaaccccaaaaccggcgaatcattagcactacccagacgactatctagaagcgctagaaagcgcctggcacgaagaaaagcaagacttaaccatttaaaacatctgattgcaaatgaattcaaattaaattatgaagactatcaaagctttgacgaaagcctagccaaggcgtataaagggtcacttatatcaccatacgaactaagattcagggctctaaacgaattcttatcaaaacaagacttcgcaagagtaatactccatatagcaaaacgtagggggtatgacgacataaaaaataacggagatgaggaaaagggcgaaatacttaaagcaatcaaacaaaatgaagaaaagttagtctcataccaatcagtaggtgagtacctatacaaagagtattttcaaaaattcaaagaaaactccaaagaattcataaatgtccgaaataaaaaagaatcatacgaacgatgtatcgcacaatcatttcttaaagacgaacttaaattaatcttccaaaaacaacgagaattcggattcagcttttctaaaaaatttgaggaggaagtattatcagtagccttttacaaacgcgcattaaaagactttagccacttggtaggaaattgctcattctttactgacgaaaaacgagcgccaaaaaattcgccattagcattcatgttcgttgcattaacccgaataataaacttactaaacaatctaaaaaatacggaaggaatactatataccaaagacgacctgaatacgctactaaacgaagtattaaaaaacggaactctaacctacaaacaaactaaaaaattactaggattatccaacgactatgaattcaaaggagaaaaaggtacatattttatcgaattccagaaatataaagaatttgtaaaagccttaggagaacacaatctgagtcaagacgatctaaatgaaattgcaaaagacatcaccctaataaaagacgaaataaaattaaagaaagctctagccaaatacgacctaaaccaaaatcaaatagattccctgagcaaactagaatttaaagaccatctaaatataagctttaaggcccttaaactaataactcctctaatgctagaaggtaaaaagtatgacgaagcgtgtaacgaacttaacctaaaagtagctattaatgaagataaaaaagattttttaccggcattcaatgaaacatattacaaagatgaagtaactaacccagtagtactcagagcaatcaaagaatatagaaaagtactcaatgctctgctcaaaaaatacggaaaagttcacaaaatcaacatagaactagcaagagaagtcggaaaaaaccattcccaaagagcaaaaattgaaaaagaacaaaatgaaaactataaagctaaaaaagatgcagaacttgaatgtgaaaaattaggactcaaaatcaactcaaaaaacatactaaaactacgactattcaaagaacaaaaagaattttgcgtttatagtggagaaaaaattaaaatatccgacctacaagatgaaaagatgctcgagatagaccatatatatccatacagtagatcattcgacgattcctatatgaataaggttctagtcttcacaaaacaaaaccaagaaaaattaaataaaacaccattcgaaaccttcggtaatgatcgcgtcaaatggcaaaaaattgaggtactcgccaaaaatctaccaacgaaaaaacaaaagcgcatattagataaaaactacaaagacaaagaacagaaagacttcaaagacaggaacctaaatgacacaaggtacatagcaaggcttgtactaaactacacaaaagactacctagactttctaccactatcagacgacgaaaataccaaattaaacgatacccaaaaaggtagtaaagtacacgtagaagcaaaatcgggaatgctaacaagtacgttacgacacacttggggattcagtaccaaagatcgagataaccatttacaccacgcaattgacgcagcaataatagcctatgctaacaatagtatagtaaaggccttttccgactttaaaaaagaacaagagtcaaacacagctgaactatacgccaaaaaaatttctgagctagactacaaaaacaaaagaaaattctttgaaccattcagcggctttagacaaaaactattagataaaatagatgaaatctttgtatcaaaaccagagcggaaaaaaccaagcggggctcttcatgaagaaacgttcagaaaagaagaggaattctaccaatcctacggcggcaaagaaggagttctaaaagcactagaactaggaaaaatcagaaaagtaaacggtaaaatggtgaaaaatggagatatgttccgtgttgacatctttaaacataaaaaaactaacaaattctatgcagtaccaatttatacaatggattttgcactcaaagtactaccaaataaagcagtagtccaaggaaaagacaaaaaaagcggactaattaaagactggattctgatggatgaaaactatgaattttgtttctcactatataaagactcactaatcctaatacaaacaaaggacatgcaagagccagaacttgtatattatgaaagactagactctagcaacgcctcattaacggtttcaaaacatgataataaatttgaaacattaagcaaaaaccaaaaaatattattcaaaaacgcaaacgagaaagaagtcatagcgaaatccataggaatccaaaacttaaaagtatttgaaaaatatatcgtgagcgccctcggcgaagtcactaaagcagaattcagacaacgagaagactttaaaaaatga

SEQ ID NO: 4889 - RNA, 2964 nt, synthetic construct
  misc_feature 1..2964: note = Cas9 variant
  source 1..2964: mol_type = other RNA
atggcacgaattctcgcattcgacattggaataagctccataggatgggcattctcagaaaacgacgagctcaaagattgtggcgtaagaatcttcacaaaagcagagaaccccaaaacaggagaatcattagcattaccaaggagactcgccagaagcgcccgaaaacgtctcgcaagaaggaaggccagattaaaccacctaaaacatcttatagcaaatgaattcaaactaaattacgaagactatcaaagtttcgacgaatcactggcgaaagcatacaaagggagcctcatctcaccatacgaactcagattcagagcattaaatgaactactctccaaacaagacttcgcaagagttatactacacatagcaaaaagacgaggatatgacgacataaaaaactcagacgataaagaaaagggagccatattaaaagccataaaacaaaatgaagaaaaattagcaaactaccaatcagtaggagagtatctatacaaagaatacttccaaaaattcaaagaaaactccaaagaattcacaaacgtaagaaacaaaaaagaatcctacgaacgttgtatcgcccaaagttttttaaaagacgaattaaaactcattttcaaaaaacaaagagaattcggctttagttttagcaaaaaatttgaagaagaagtcttaagtgtagcattctataaaagagcattaaaagacttctctcatctcgtgggaaactgttccttcttcactgacgaaaaaagagccccaaaaaattcacctttagcatttatgtttgtagccctaacaagaataattaacttactaaacaacctaaaaaacacagaaggaatactatacacaaaagatgacttaaacgcattgcttaacgaagtattaaaaaacggaacattaacatacaagcaaacaaaaaaacttctaggactatccgacgattatgaattcaaaggcgaaaaaggaacctactttatcgaatttaaaaaatacaaagaattcataaaggcactaggagaccactccctgtctcaagacgatctcaacgaaatagctaaagacatcactcttataaaagatgaaattaaactcaaaaaagcattagccaaatacgatttgaatcaaaatcaaatagatagtctcagtaaactagaatttaaagatcacctaaacataagtttcaaagcattaaaacttataacgcccttaatgctcgaaggaaaaaaatacgatgaagcttgcaatgaacttaatctaaaagtcgcaattaacgaagataaaaaagattttctcccagcgttcaatgaaacctactacaaagacgaagtaacgaatccagtagttctcagagcgataaaagaatatcgaaaagttctcaatgccttactaaaaaaatacggaaaagtccacaaaattaacatcgaactagcaagagaagtagggaaaaattattcacaaagagcaaaaattgaaaaagaacaaaatgaaaattacaaagctaaaaaagacgctgaactcgaatgcgaaaaacttggcttaaaaattaactcgaaaaacatactcaaactacgactattcaaagagcaaaaagaattttgcgcatattcgggtgaaaaaatcaagatctctgatttacaagatgaaaagatgcttgaaatagaccacatatatccatatagcagatcattcgatgacagctatatgaacaaagttctcgttttcacgaaacaaaatcaggaaaaactaaatcaaacaccttttgaagcattcggaaacgactctgctaaatggcaaaaaatagaagtacttgcaaaaaaccttccaaccaaaaaacaaaaaagaatccttgacaagaattacaaagacaaggaacaaaaagacttcaaggatcgaaacttaaacgacactcgctatatcgctcgtctcgtcttaaactatacaaaggactacttagattttctcccactctcagatgacgaaaacacaaaactaaatgacacacaaaaaggatctaaagtacatgtagaagcaaaatcaggcatgctcacttcagcattaaggcatacatggggattctcagctaaggaccggaataaccacctacaccatgcaatagatgcagtaatcatcgcctacgccaacaacagcatagtaaaagctttcagtgacttcaaaaaagaacaagaatctaacagtgccgaactctatgcaaaaaaaattagcgaactggactacaaaaataaaagaaaattcttcgaaccattctcaggattccggcaaaaagtactagacaaaatcgacgaaatattcgtatcaaaacccgaaagaaaaaaacccagtggcgccctacacgaagaaaccttcagaaaagaagaagaattttatcaatcatacggaggaaaagaaggagtgctaaaagcgttagaactaggaaaaatcagaaaagtaaacggtaaaatagtaaaaaatggcgacatgttccgagtcgatatctttaagcacaaaaaaaccaacaaattctatgcagtgccaatatatacaatggattttgcactaaaagttttacctaacaaagctgtggcacgatcaaaaaaaggagaaatcaaagattggatattaatggatgaaaattacgaattctgcttttcgttatataaagactcactaatacttatccaaactaaggatatgcaagaaccagaattagtatactttaacgcattcacttcatcaacagtatcattaatagtaagtaaacacgataacaaatttgagacactaagcaaaaaccaaaaaatactctttaaaaatgccaatgagaaagaagtgatagccaaatcaataggaatacaaaaccttaaagttttcgaaaaatacatcgtaagcgcactaggagaagtcacaaaagcagaattccgccaaagagaagatttcaagaatgaattacgatga

SEQ ID NO: 4890 - RNA, 2964 nt, synthetic construct
  misc_feature 1..2964: note = Cas9 variant
  source 1..2964: mol_type = other RNA
atggcaaggatcctggcattcgacataggaataagctcaatcggatgggcattcagcgaaaatgatgaattaaaagactgcggcgtacgcatctttacaaaagccgaaaacccaaaaacaggagagagcttagccctcccacgccgacttgcaagaagcgcacgtaaacgattagctagaagaaaagcaagattaaaccatttaaaacatttaatagctaatgaatttaaactaaattacgaagattaccaatcttttgacgaatctttagcaaaagcatacaaaggctcactcataagtccttacgaactcagattcagagccctaaacgaactattaagtaaacaagatttcgcgcgggtaatcctgcatatagccaaaagaagaggatatgacgacattaaaaataatggcgacgaagaaaaatcagaaatactcaaagccataaaacaaaatgaagaaaaactcgtgaactatcaaagcgttggagaatatttatacaaagaatattttcaaaaattcaaagaaaacagcaaagaatttataaatgtaaggaacaagaaagaaagctacgaacggtgtatagcacaaagttttctaaaagatgaactaaaattaatatttcaaaaacaaagagagttcggattctcattctcgaagaaattcgaagaagaagtattaagcgtagcattttacaaacgcgcactaaaagacttttctcatctagtaggcaactgctcatttttcacggacgaaaaacgagcacccaaaaactccccattggtattcatgtttgtagccttaacgagaataataaacctgcttaataatctcaaaaatacagaaggaatattatacacaaaagacgacttgaacgcattactcaatgaagtactaaagaatggtacactaacatacaaacaaacaaagaaattattgggcctcagtgacgattatgagttcaaaggtgaaaaaggcacatacttcatagagttcaagaaatataaagagttcatcaaagcgctcgacgaacacagcttatcacaagacgatttaaacgaaatagcaaaagacattaccctaataaaagacgaaattaaactaaagaaagcactcgccaaatacgacctaaaagaaaatcaaattgattcattatcaaaactagaatttaaagaccacctcaacatcagcttcaaagctctaaaattaataacaccattaatgttagaaggcaaaaagtacgatgaagcatgcaacgaactaaatctcaaggttgccataaacgaagacaagaaggatttcctaccagcattcaacgaaacatattacaaagacgaagtaaccaatccagtagtactccgcgctataaaagaatatagaaaaatattaaacgctctattaaagaaatacggaaaagttcataaaataaatattgaactagcacgcgaagtaggtaaaaaccactcgcaacgagctaaaatcgaaaaggaacaaaacgaaaattataaagcaaagaaagatgcagaactcgaatgcgaaaaattgggcttaaaaataaattctaaaaacatcctaaaactaagactatttaaagaacaaaaagaattttgcgtatactcaggcgaaaagatcaaattatcagacttgcaagatgagaaaatgttagaaattgatcatatctacccttatagcaggagcttcgacgactcatacatgaataaagtattagtattcgccaaacaaaaccaagaaaaactaaataaaaccccattcgaagcattcggaaatgactcaacgaaatggcagaaaatagaagtcctaactaaaaacctaccaacaaagaaacagaaaagaatcctagacaaaaactacaaagacaaagaacaaaaagacttcaaagacagaaatctaaatgatacacgatacatagcacgactcgtcctaaattacaccaaagattacttagatttcctaccactatcagacgacgaaaacacaaaactcaacgatacacaaaaaggcagtaaagtacatgtggaagcaaaatcaggaatgttaaccagtgcattaagacacacgtggggattcagtactaaagaccgaaataaccatctccaccacgccatagacgcagtaataatagcttatgcgaacaacagtatagtaaaagcattttccgactttaagaaagaacaagaaagcaacagcgcagaactatacgccaagaaaataagtgaattggactataaaaacaaaagaaaatttttcgaaccatttagcggattcagacaaaaagtactagacaaaatagacgaaattttcgtctctaaaccagaacgaaagaaaccatcgggcgcactacacgaagaaactttcagaaaagaagaagagttctaccaatcctacggcggaaaagaaggggtactcaaagcattagaattaggcaaaataagaaaagtaaacggaaaaatagtgaaaaacggcgacatgtttcgtgtagacatattcaaacataagaaaaccaacaaattctacgcagtacccatatacacaatggattttgcactaaaagtactacccaacaaagcagtagcgcgatctaagaaaggagaaataaaagactggattctgatggacgaaaactatgagttctgcttctccttatacaaagattctctaatcctaatacaaacaaaagatatgcaagaacccgaactcgtatatttcaatgcttttacaagtagcacagttagcttaatagtaagcaaacacgacaacaaattcgaaacattaagtaaaaatcaaaagatactatttaaaaatgccaacgaaaaagaagtaatagcgaaatcaataggaatacaaaacctaaaagtcttcgaaaaatacattgtatcagcacttggagaagtaacaaaagcagaatttcgacaacgcgaagactttaaaaacgaactccgatga

SEQ ID NO: 4891 - RNA, 2964 nt, synthetic construct
  misc_feature 1..2964: note = Cas9 variant
  source 1..2964: mol_type = other RNA
atggcaagaatcctagcattcgacatcggtataagttcaataggctgggccttttcagaaaatgacgaactcaaagactgcggcgtgagaatattcacaaaagcagaaaaccctaaaacaggggaatccctagcattaccaagacgactagcccgatccgctcgaaaaaggctagcaagaagaaaagcccgactaaatcacttaaaacatctaatagcaaacgaatttaaactaaactacgaagattaccaatcattcgacgaaagtctagcaaaagcatacaaaggaagcctcataagcccatatgaactgagattccgcgcactcaacgaacttctatcaaagcaagacttcgctagggtgatactgcacatagctaaacgaagaggttacgatgatatcaaaaactcagacgataaagaaaaaggcgcaatattaaaagctattaaacaaaacgaagaaaaattagcaaactaccaaagcgtcggagaatacctctataaagaatactttcagaaattcaaagaaaattcaaaagaatttacaaatgttcgaaataagaaagaatcatacgaacgctgcatagcacaatcattccttaaagacgaactcaaactaatatttaaaaaacaaagagaatttggtttctcattttctaaaaaattcgaagaagaagtcttatcagttgcattttacaaacgcgcattaaaagattttagtcacctagtaggaaattgcagtttctttacggacgaaaaaagagccccaaaaaacagtccactagcattcatgtttgtagcattaacaaggataattaaccttctaaacaacttaaaaaatactgaagggatactatacactaaagacgacctaaatacactattaaatgaagttctaaaaaatggaacactcacatataaacaaaccaaaaaacttctaggcctatcagatgattacgaattcaaaggagaaaaaggcacatattttatagagttcaaaaaatacaaagaattcataaaagcgttaggcgaacacaatttatcgcaagacgacctaaacgaaatcgcaaaagacataacactaataaaagatgaaataaaattaaaaaaagcgctagcaaaatacgatctgaatcaaaaccaaatagactcactctctaaactagaatttaaagaccacttaaacatctcatttaaggcacttaaattagtcacaccactaatgctagaaggcaaaaaatatgatgaagcttgtaacgaactcaaccttaaagtagctatcaacgaagataaaaaagatttcttaccagccttcaatgaaacttactataaagacgaagtaaccaacccagttgtactacgtgcaattaaagaatacagaaaagtactaaacgcactactaaaaaaatatggcaaagtacacaaaataaatatagaactcgcacgtgaagtaggtaaaaatcactcgcaaagagctaaaatagaaaaagaacaaaacgaaaattacaaagcaaaaaaagatgcagaattagaatgcgaaaaactaggtttaaaaataaactcgaaaaacatactaaaactaagactatttaaagaacaaaaagaattttgcgcatatagtggcgaaaaaataaaaataagcgacttacaagacgaaaaaatgttagaaatagatcatatctacccctattcaagatcatttgacgactcatatatgaataaagttctagtatttacaaaacaaaatcaggaaaaactaaaccaaacaccatttgaagcattcggtaacgacagcgcaaaatggcagaaaattgaagtactcgcaaaaaacttaccaacaaaaaaacaaaaacgaatactagacaaaaactacaaagacaaagaacaaaagaacttcaaagatagaaatttgaatgacaccagatatatagcaaggttagtattaaactacacaaaagattacctagacttcttaccactatcagacgacgaaaatactaaactcaacgacacacagaagggatcgaaagtacatgtagaagcaaaaagtgggatgctaacatccgcactgcgacacacgtggggattttcggcgaaagacaggaataaccatttacaccacgccatagacgcggtaataatcgcttacgcaaataacagcattgtaaaagcattctccgatttcaaaaaagagcaagaaagcaactccgctgaattatacgcaaaaaaaatttcagaactagattacaaaaacaaaaggaaatttttcgagcctttcagcggatttaggcaaaaagtcttagacaaaattgacgagatctttgtttctaaacctgaaagaaaaaaaccaagcggagccttacatgaagaaacattccgaaaagaagaagaattttaccaatcctacggaggaaaagaaggcgtcttaaaggcactagagctaggaaagataaggaaagtcaatgggaaaatagtaaaaaacggtgatatgttccgagtagatatattcaaacacaaaaaaacaaataagttctatgcagtacctatatacacaatggacttcgctttaaaagtcctccctaacaaagcggtagcacgctcaaaaaaaggagaaattaaagattggatactaatggacgaaaactacgaattttgctttagtctatacaaagattcactaattctaatacaaacaaaagatatgcaggaaccagaactagtatatttcaacgcattcacctcaagtacagtaagcctaatcgtatccaaacacgataataaattcgaaaccctaagcaagaatcaaaaaatactattcaaaaatgccaatgaaaaagaagttatagctaaatcaattggcatacaaaatctaaaagtttttgaaaaatacattgtaagcgccctgggagaagtcactaaggcagaattccgacaacgagaagacttcaaaaatgaactaagatga

SEQ ID NO: 4892 - RNA, 2964 nt, synthetic construct
  misc_feature 1..2964: note = Cas9 variant
  source 1..2964: mol_type = other RNA
atggcaagaatattagcattcgacattggaataagcagtattgggtgggcgttttcggaaaacgatgaattaaaagattgcggagtaagaatctttacgaaagcagaaaatccaaaaacaggagaaagcctcgccttacctcgacgactagctagatcagcaagaaaaagactagcaagacgaaaagcacggcttaaccatctaaaacacctaatcgcaaatgaatttaaactaaattacgaagactaccaaagtttcgacgagagcttagctaaagcatataagggcagtctcataagtccctacgaactacgattccgagcactaaatgaactactatccaaacaagactttgcgagagtaatactacatatagcaaagcgtcgaggatacgatgatataaagaactccgatgacaaagaaaaaggagcaatcttaaaagcaatcaagcaaaacgaagaaaagctagcgaactaccaatcagtaggagaatacctctacaaagaatattttcaaaaattcaaagaaaatagtaaagagttcacgaacgtacgtaacaaaaaggaatcatacgaaagatgcatagcgcaatccttccttaaagatgaattaaaactcatattcaagaaacaaagagaatttggattctcattttccaaaaagtttgaagaagaagtacttagcgtagcattctacaaaagagcattgaaagatttctcacatctagtagggaattgttcattctttacagacgaaaaacgcgccccgaaaaattcaccactagcatttatgtttgtcgcactaacaagaataataaacttattaaacaacctaaagaacacagaaggtatattatataccaaagacgacttaaacgcactattaaatgaagttctcaaaaactccaccctaacctacaaacaaacaaagaaactactaggtttaagcgacgactacgagttcaaaggcgaaaaaggcacatatttcatagaatttaagaaatataaagaatttatcaaagcactcggcgaccactccctaagccaagacgacctaaacgaaatcgcaaaagacattaccttgattaaagatgaaatcaaattaaagaaagcacttgcaaaatacgacttaaaccaaaaccaaatcgattctctttcaaaattggaatttaaagatcatttaaatatatcattcaaagcattaaaacttataacaccactaatgttagaagggaagaaatacgacgaagcatgtaacgaattaaacttaaaagtagcaataaacgaagacaagaaagacttcttaccagcattcaatgaaacgtattataaagacgaagtcacaaacccagtagtattacgcgcaataaaagaatacagaaaagtattaaatgcactactaaagaaatacggaaaagtacacaaaattaacatcgaactagctagagaagtagggaaaaactacagtcaaagagcgaaaatcgaaaaagaacaaaatgaaaattacaaagccaagaaagacgcagaactagaatgtgagaaattaggattaaaaattaactctaaaaacattctgaaactgcgcctatttaaagaacaaaaagagttctgtgcatacagcggagagaaaataaaaataagtgacctacaagatgaaaagatgttagaaatagaccacatatacccatatagtaggtccttcgatgatagctacatgaataaagtactcgtattcactaaacaaaaccaagaaaaactaaataaaacaccattcgaagccttcggcaatgattcagccaaatggcagaaaatcgaagtattagccaaaaacctaccaactaagaaacaaaaacgaatattagacaaaaattataaagacaaagaacaaaaagactttaaagacagaaatttaaacgacaccagatacatagcacgacttgtactaaattataccaaagattacctagacttcctacctctctcagatgatgaaaacaccaaacttaatgacactcaaaaaggctcaaaagtacacgtagaagcaaaatccggtatgctaaccagtgccttaagacatacttggggtttttctgcaaaagacaggaacaatcacctacaccatgctatagacgcagtaataatagcatatgcgaacaacagcattgtcaaagcattttctgacttcaagaaagaacaagaaagcaattcagcagaactatacgccaagaaaatcagtgaacttgactacaaaaacaaaagaaaatttttcgaacccttcagcgggttcagacaaaaagtactagacaaaatagatgaaatatttgtaagcaaaccggaaagaaagaaaccgtccggagcactacacgaagaaacatttagaaaagaagaagagttctaccaatcatacggaggcaaagaaggagtcttaaaagcactagaattaggaaaaatcagaaaagtaaatggcaaaatcgtcaaaaatggagatatgttccgagtagacatctttaaacataagaaaactaacaaattctatgcagtaccaatatacaccatggatttcgccttaaaagtattaccaaataaagcagtagcaagatcaaagaaaggagaaataaaagattggatactaatggatgaaaattatgaattttgcttttctctctataaagatagcctaattctgattcaaacaaaagatatgcaagaaccagagctagtctacttcaatgcatttacatcctcaacagtttcactgatagtaagcaaacatgacaacaaatttgaaacgctaagcaaaaaccagaaaatactatttaaaaacgcaaatgaaaaagaagtaatagcaaaatcaataggaatacaaaatctcaaagtattcgaaaaatacatagtaagcgcattaggcgaagtaaccaaagcagagttcagacaaagagaagatttcaaaaacgaactaagatga

SEQ ID NO: 4893 - RNA, 2964 nt, synthetic construct
  misc_feature 1..2964: note = Cas9 variant
  source 1..2964: mol_type = other RNA
atggctagaatattagcattcgacatcggaatatcctctatcgggtgggcattttcagaaaatgatgaacttaaagattgcggagtaagaatattcactaaagcagaaaatccaaaaacaggagaatcactggcactacctcgcagactagccagaagtgcacgaaaacgactagcacgtagaaaagcacgcctaaaccatctaaaacacttgatagctaacgagtttaaacttaattacgaagactatcaaagctttgacgaatccctcgcgaaagcttacaaaggatcattaatttcaccatacgaactcagattcagagcactaaacgaattactaagtaaacaagattttgccagagtaatcctacatattgcaaaacgtagaggttacgacgacataaagaattcagacgacaaagaaaaaggcgcaatattaaaggctataaaacaaaacgaagaaaaattagctaattaccaatcagtaggcgaatacctctacaaagagtattttcaaaaattcaaagaaaattccaaggagtttaccaatgtcagaaataagaaagagtcatacgaaagatgcatagcacaaagttttctaaaagacgaactaaagttaatattcaaaaaacaaagagaattcggattttctttctcaaaaaaattcgaagaagaagtattatcagtagcattctataaacgagcattaaaagacttctcacacctagtaggaaactgttcattcttcacagatgaaaagagagcaccaaaaaactcaccactagcattcatgttcgttgccctaacccgaataattaacttattaaataatctcaaaaatacagaagggatactatacactaaagatgatttaaacgcgctactaaacgaagttcttaaaaatggaacgctaacatataaacaaacaaaaaaactactcgggttatcagacgactacgaatttaaaggagaaaaaggaacatactttatcgagtttaaaaaatacaaagaatttataaaagctctaggagaccacagcttaagtcaagacgatctaaatgaaatagccaaagacataacgttaataaaagacgaaatcaaactaaaaaaagcgctcgcaaaatacgacctaaaccaaaaccaaatagactcattaagtaaattagaattcaaagatcacctaaacatttcatttaaagcactaaaactaataacaccacttatgcttgaaggaaaaaagtatgatgaagcatgcaacgaactcaacctgaaagtagcaataaacgaagacaaaaaagacttcttaccggctttcaatgaaacgtactacaaagatgaagtgacgaacccagtcgttttaagagccataaaagaatacagaaaagtattaaatgctttattaaaaaaatatggtaaagttcacaaaataaatatcgaattagcgagagaggtaggaaaaaattacagccaaagagccaaaatagaaaaagaacaaaacgaaaactacaaagcaaaaaaagacgctgaacttgaatgcgaaaaactgggcctcaaaataaactcaaaaaacatcctaaaactcagacttttcaaagagcagaaagaattttgcgcttactcaggtgaaaagataaaaatcagcgatttacaagacgaaaaaatgttagaaatagatcacatctacccctactcacgatcattcgacgattcttatatgaataaagttttagttttcaccaaacaaaaccaagaaaaattaaaccaaactcccttcgaagcgttcggaaacgatagtgccaaatggcaaaaaatagaagttctagccaaaaatctacctaccaagaaacaaaagagaatattggacaaaaactataaagacaaagagcaaaaagattttaaagacagaaatctaaatgatacaagatacatagcacgactagtattaaactataccaaagactacttagatttcctaccgctaagtgacgacgaaaatacaaaactaaacgatacacaaaaaggttcaaaagtacatgtggaagccaaatctggaatgctaacaagcgctttaagacatacttggggattcagtgcaaaagatagaaataaccacctgcatcatgccatagatgcagtaataattgcatacgcaaataattctattgtaaaagcctttagcgatttcaaaaaagaacaagaaagcaatagtgccgaattgtatgcaaaaaaaatttccgaactagattataaaaataaaagaaaattttttgaaccttttagcggatttaggcaaaaagtattagacaaaattgatgaaatatttgtatctaaacccgaaagaaaaaaaccaagtggtgccctacacgaagaaacattcagaaaagaagaagaattctatcaaagctacggaggaaaagaaggcgtactaaaagcattagaactcggcaaaattagaaaagtaaatggtaaaatcgtaaaaaatggagatatgttccgcgtagacatatttaaacacaaaaaaacaaacaaattctacgccgtgcctatctacacaatggacttcgcccttaaagttctaccaaacaaagcagtcgcgagatctaaaaaaggcgaaataaaagattggatattaatggatgaaaattatgaattttgcttctcactctacaaagattcacttatccttattcaaacaaaagatatgcaggaaccagaatttgtatactacaatgcatttacaagctctaccgtctcattaatcgtaagtaaacatgataacaaattcgaaaccttgagcaaaaaccaaaagatactattcaaaaacgcaaatgaaaaagaagtaatagcaaagtctataggaatccagaacttaaaagtctttgaaaagtatatcgtgtcagcattaggtgaagtaactaaagcagaattcaggcaacgggaagacttcaaaaacgaactacgatga

SEQ ID NO: 4894 - RNA, 2979 nt, synthetic construct
  misc_feature 1..2979: note = Cas9 variant
  source 1..2979: mol_type = other RNA
atgagaatatttagcgatgggagaaatccaaaagatggatcaagccttgccgtaactagaagggcagctagagcaatgagaagaagaagagaccgtcttttaaaaagaaaaacaagaatgcaagcaaagctagtagaacatggattctttcctgctgatgcaggaaaaaggaaagccttagagcaactcaatccatatgcattaagggcaaaaggattacaagaagcattgttaccaggtgaatttgcacgggccttatttcatataaatcaaagaagaggatttaaatcaaatagaaaaacagataagaaagataatgactctggagtgttaaagaaagctattggtcaattaagacaacaaatggcagaacaaggaagtcgtactgtaggagaatatctatggactagactacaacaaggtcaaggcgtaagagcacggtacagagaaaaaccatatacgactgaagaaggaaagaaacgaatagacaaatcatatgacttatatatagatagagcaatgatagaacaagaatttgatgcactatgggccgcgcaggcagcattcaaccctacattgtttcatgaggcagcaagagcagacttaaaagacacattactacatcaaaggccacttagaccagtaaaaccaggaagatgtacactcctaccagaagaagaaagagcaccactagcgcttccgagtacacaaagattccgaatacaccaagaagtcaatcacttacgacttctagatgaaaatctaagagaagtggcactaactctagcgcaacgagacgcggttgttacagctcttgagactaaagctaaattatcattcgaacaaattcgaaaattgttaaaattaagtggaagtgtacagttcaatcttgaagacgcgaaaaggacagaactaaaaggtaatgcaactagcgcagctttagccagaaaagaattattcggcgctgcttggagtggatttgatgaagctctacaagacgaaatagtatggcagttagtgactgaggaaggagaaggagcgcttatagcgtggctgcagactcacacgggtgtcgacgaagcaagagcacaagcaatagtggacgtgtcattaccagaaggatatgggaatttatccagaaaggctttagcaaggatagtacccgcattacgagctgctgtaataacgtatgataaagctgtacaggctgcaggttttgatcaccatagccaactaggatttgaatatgacgcctcagaagtggaagatttagtacatccagaaacaggagaaatccgaagtgtatttaaacaactaccatattatggaaaagcactacaaaggcatgtcgcattcggttcaggcaagccagaggatccggatgagaaaagatatgggaaaatagctaacccaacagtacacataggtctgaaccaagtcagaatggtagtaaatgcgttaataagaagatatggtagaccgacggaagtggtaatcgaattagcaagagaccttaaacaaagtcgggaacaaaaagtcgaagcccaaagaagacaagcagataatcaaagacggaatgcaagaattagaagaagtatagcagaagtattaggtataggagaagaaagagtaagaggaagtgatatacaaaagtggatatgctgggaggaactctccttcgacgcagcagatagaagatgcccatatagtggagtacaaataagcgcggctatgctactctctgacgaggttgaagtagaacatatattacctttctcaaaaacgctagacgatagcctcaacaatagaacagtagctatgaggcaagcgaatagaatcaaaagaaatagaacaccatgggatgcaagggcagaatttgaagcacaaggatggtcctacgaagatatattacaaagagcagagagaatgccattacgaaaacgatatcgctttgcccctgatggttatgaaaggtggttaggagacgacaaagatttccttgcacgagctttaaatgataccaggtatttaagtagagtagcagcggaatacctgcgacttgtatgcccgggaacaagagtcataccaggacaattaactgcactattgagaggaaaatttggcttgaatgatgtcttaggcttagatggtgagaaaaatagaaatgaccatcgacatcacgcagtagacgcgtgtgtaataggagttaccgatcaaggattaatgcaacgcttcgcaacagcgtcagcacaagctaggggagacggcttaacgcgactggtggacggtatgcccatgccgtggccaacatacagagatcacgttgaaagagcagtacgtcacatatgggttagtcatagaccagatcatggttttgaaggtgctatgatggaagaaacttcgtatggtataagaaaagacgggagcataaaacaaagaagaaaagcagacggatcagctggtagagaaataagtaatctaattagaatacacgaagccacacaaccgttacgtcacggagttagcgcggacggacaaccccttgcatataaaggatacgtaggaggaagcaattactgcattgaaataacagtgaatgacaagggcaaatgggagggcgaagttatttcaacatttagagcctacggtgtagtacgtgcaggagggatgggaagattacgaaatcctcatgaaggtcaaaacggtagaaaacttataatgagattagtcataggggatagtgtccgattggaagtagatggtgcagaaagaaccatgagaatagtaaaaatatcaggtagtaacgggcaaatattcatggcacccatacacgaagctaacgtagacgcccgaaatacggacaagcaagatgcattcacatacaccagtaagtacgcaggaagtttacaaaaagcgaagacaagaagggttaccatatcaccaataggcgaagtgagagatccaggttttaaaggatga

SEQ ID NO: 4895 - RNA, 2985 nt, synthetic construct
  misc_feature 1..2985: note = Cas9 variant
  source 1..2985: mol_type = other RNA
atgactctcggattagacttaggaacgaacagcataggatgggcattgatagattttgacgataaccaacaaccgagaaatctgatagcttgcggatcaagaatatttcaagaagctgtagaagcaaaaacaggtacccccaaaaatcatgcaagaagaacagccagagcagctcgcaaattagttgctcggagaaaacaaagacgaacaaaactattaaacctgctaataaggcatggcttattacctcaagacgttgcagaaagaaatgcactattattagacaaccaggctaacaacccctaccaattacggaaacgaggattagatgaaaaacttgaaccttttgcttttggtagagccttatatcatctcgctcatcgaagagggtttcaatccaatcgaaaggcagctagtgatgaagatgggaaagtcaaaacggcgatttcaactttaagagccgaaatgcaaggaagaacattaggagcctttttggcagaccaaccaacgcaaaggcgacgatatactgacagggcaatgtacgtagaagaatttgaacaactatggagtaagcaggcaagttttacccaagaacaattaacacaggcactcaaagtagcaatacataattctatcttcttccaaagaccattaaaatcacaaaaacacctagtaggtaagtgcacatttgaaccgactagaaaaagagccgcaaaagcaatacttttaacccaaagatttagaattttacaagacgtaaatcatttagcagtaaagaacccaattaccagagaatttagaccattaactcaagatgaacggaacaaattagccgaagcacttgacaaacagaaatccatgacatggggagcggttcgaaaagtaataggttggaataagaaagattcgttacatgaaggtgaaacatttaatttggaagagggtaagaaagacaaattaataggaaatagaacggcatgtgacctcagaggagctctcggagatagatgggacgctttaactgcacaacaacaggacgatctagtaacagacttgttgacaatagacaacacggatggatttttaaaaagaatgaaaacacactgggaatttgacgacgcaacagccgaagtaattgcaaaaatagaattagaacctggctatgcgagattatcagcaaaagcaatgagggcaatactgccatatctagaacaaggaatgatttactcagacgcatgcaaagctgccggatatgaccactcaaatccaaatcaaagaacgatcacagacaaattaggactaccatcaaatgtaagaaaccccgtagtacagaaagcactttttgaaactagaaaagtagtaaatgccatagttagaaaatatggcaaaccagcagtaataagagttgaaatggcaagagatatgaaactgtcaaagcgccagaaagaagaactccaaaaagaacaaaataaacaaaagaaagctaatgaattagcagaaggaattttaagaaaagagttcggaatacagcaaccagctagagcagacattcaaaaatacaacttgtggttagaatgtaaagaagtttgcccttatacaggtacaaccatttcaagagaaatgctattttcaccagaagttgatgtcgaacatatactaccatatagtcgatcccttgatgattcttatatgaataaaacactatgcatggccaccttcaacaggcaggttaaactaaataacacaccttacgagattgggcaaggagatccattagcttatgcagaaatatttcaaagaataaaaacattgccatttccaaaacgaagaagatttgaacaaaaagaaatagaaacagataaattcatagaacgacaactaaatgatactaggtatatatgcgtagaagtacgagactttctacaacaattgggagcaccagtagaagtctcaaagggagaagctactgcgaaattaagaggaagatggaaattaaacacactattaagcccagatggatcaaacgaaaaatatagaggagatcacagacatcatgcaatagatgcagttgttattgcactcactaatcggagtctctttcataaattgagtagattatcagcacaatcaataagtttagacaaaagcagatttgacgtacccccaccctgggacggattttatgacgacgtatacgagaaaatcgacaaagtaatagtatcacacgcaccagctagaaaaataggtggagctctccatgaagacactgcgtatggtcattttaaagaagaagtagctgatcccaaaacaggaaaagtaagtatagaggacagattcgtatatagaaaaccattagccacgctcacagcaaacgaagttggtaaaataagagacgcaaaagtccgagaatttgtcgaagctcgactcgcccaattcggaaataactcaaaaacagccttcggagatccaaataacccattactacacgcagacggtaaaacgccaatacgaacagttagattagtaacaaattttaacaaagccaccacacatgcaatacaaaaaggccaaggtagagactacaaatttttcaaatacggtaacaatcatcatgtagagattatagaacacgttgaaaccggaaaacgaaaaggaatcttcgtaacagcaatggaagcagcaagaagagtacgcggagtagctaatacagaaaagtcagatatcgtccaaagaaatcacggagaggaatggagattcgtaatgtctttatcaataaatgaccttgtaagtattcaggaagctgatcaagtcagaataatgagagtacaattgtttgatgcctcaaatgggaatataatatttagagatcaaaaatcagcaatgctagatgacaagctatcacgctatcaaacgaaagcccatctgctagtatgtcagaaaattaccaccgatccactaggaaatctagcaccttgtaatgattga

SEQ ID NO: 4896 - RNA, 2988 nt, synthetic construct
  misc_feature 1..2988: note = Cas9 variant
  source 1..2988: mol_type = other RNA
atgtcaaaagttctaggactagatataggagcaaacagcataggatgggcccttatcgatgacgaagaaaacgatataataggtgcaggggtacgggtattcaaagaaggagtcaatttaaagggagtaaaagaagaaagtaaaaatgtagaaagaagagcagcaaggttagcccgaagacaacataaaagacgaagccaaagacggaatagactagtcgcactactaaaaacccttgaaatgtttccagagaataacgaagatatttcagattactacgcacaagacccatatgaactaagaaaaaaaggcttatacgaaaaactaacaatgtatgaattcggtagagtattattacacatatgcagaagaagaggttttaaaagcagccgaaaaacagatatatcagaagaaggtaaaatctttgaaggaaaagacggaatagtaggaataaatcaaacaagagacagcataagggagggtggcttcaaaaccatcggtgaatacttagcatcacttgatccacatgttataagaaggagaaacagattcacactacgagatatgtacgaagaagaattcaacctaatgtgggagaaacaacaatcattttatcccctccaattatctaacgaattcaaagaagccatagcagaagttattctaagtcaaagaaaactaaaatcacagaaagcgctggtgggcaattgcggattagaacctaataaaaaaacagcaccgaaaagttctcctgcatttcagtactttcggatattagagcaactaagcagaattcttatatcgataccacacacgggtaggtacaatgaccctttaaacgaagaagaaaggagaatgttaatcgacaaactgtcagtcacagaaaaactcaaattcagtgacatgagaaaaatgctaaacctaccgggagaatctgacattaatatagaggaagaaggtggaagactacttggcaacaccacatacgcaaggctaataaaagttttcggaaaaaaaagatgggcaggtttttcagaagaagaaaaagaacaaatttggcacacattccatttcgcagataaccatgaatggctaaaagaatatgcattaaaaaagtggtcaataacaccagacgagattaaagaacttggaaaagtggcattagaaaaagaatatgcgcgattttctaaaaaatcactgaaaaaaataataccccaactagaagaagggctaacgctagataaagctaaaatagaagcaggttacactccagaatatgaaatagagaaaagcctaagtgcgtacttaccattaccagaaaatatccgaaacccaatcgtacaacaagcactctacgaattaagacacgtagtgaatgcggtcataagaacatacggtaaaccagatatagctagagtagaactggcaagagaaatgaaaaaacccaaacaaaaacgtgaaaaaatgagatcagagttaagaaaacgccaaatgaaatttgaagaaataaaatcaattctaaaagaaagattaggatttatagacccaaaaagagacgaaattcataaatatatgttatgggaggaatgtcgcgaaacatgtccatatactggcagaaaaatatctctctcggccctatacggtggagattttgaagtagaacatataataccctataaaagatccctagatgattcattatttaacaaaactgtgtgcttaagagaagaaaaccaaataaagggagatagaacaccatacgaggcatacagtggggaccgtcagaaatatgaagaaattattttaagagtccaaaaaacgtcaatgcctcgaggaaaaaaaaacctttttgcaatcaaagaattaaaagatgacttcgcacacagacagctatccgacacagcatatatctcacgcgaaacacgaaaataccttggcagcacaataaaaaaagtgcaagcggttaaaggtggcagcacagcaaaattacgatactactggggtctaaatagtatactgggagtacgagacataaaaatgagagacgaccatagacatcatgcagtggacgctcttgtcatagcaaatacaacttatgcttttgttaatacgctcagccgatatcactcgatggatgtagaacctcatgaatctagatttccattgccatgggaacaatttagaaatgatgctgaaagcgtagtaagaaatatattcgtgagccaccgtcttggaaaaaaagcaacgggacaattacatgaagaaacatattacggtaaaataagaaacaccgatggagagccatatttcgtcgttaggaaaaaactaggtacgttaacagccaaacaaatagcaaatattgttgatccggtagtaaagacacaagtgttcgaaagactagaagaaaaaggaatcgacatcgaatcttcaaacaaaataccagcagatgcttttgtagaaaccttatacatgccagataggaaaacacctattaaatcagtaagagttaaagtaccatcaacaactatgatacaactctacaaggacaaagaactatatgtggacccaggttcaaatcaccacatcgtaatattcgaaaatgaggaaggaaaacgagatggcatagtagtgtcactatttgaagcagcacaaagactaagaagaaacgaacctgtcatacaaaaaacatggaaaccagaatggcatttcgtaatgagtctatcaatagatgaacttatattactcgacgtagatgagaagaatatcgattggggcgatacaggattagctttgcgatactcgaaagcattatatagagttcaaaaaatggacgtaaataaaataataactctgagacaccatctcgtcgctaggttaaaagatgacgaaggaaaagaattcggaagagaacacagaatacctagcacactgaggggtctaaaagtcaaaattgatcatattggaagactaagaagggcgtatgactga

SEQ ID NO: 4897 - RNA, 2988 nt, synthetic construct
  misc_feature 1..2988: note = Cas9 variant
  source 1..2988: mol_type = other RNA
atgaaagtaataggattcgacattggaataaattccatcggatgggcattcgtagaaaacgacgaacttaaagactgcggtgtgagaatattcaccaaagcagaaaatcccaaaaacaaagaatcactagcgttaccgagaagaaacgccaggtccagtaggaaaagactaaaacgaagaaaactccgcctaattgcaatgaaacacatcctcgccaaagaacttaatttaaactacaaagactacatagcaaatgatggcgaactccccaaagcctacgaaggaaaactcatcagtccctacgaactcaggtataaagcactcaatcaaaaactggaagcgaaagacttagtcagagtaatactacacatagcaaaacaccgtggatacatgaacaaaaatgataaaaaaagtaatgacgccgaaaaaggtaaaatattgtcggcactaaaaaataacgcactaaaactagaaaaataccagtcagtaggagaatatttctacaaagaattcttccaaaaatacaaagaaaatactaaagacttcataaaaataagaaacataaaagacaactacaataactgcgtattagccagtgacctagaaaaagaattaaaactaatactcgaaaaacaaaaagaattcggatacagctactcaaatgactttatagaagaagtaatacaagtagcatttttccaacgacctctaaaagatttcagccacttagtaggaacctgcacattttttgaagaagaaaaacgagcatgcaaaaacagctactcagcatgggaatttgtagctctcacaaaaattgtaaatgaactcaaatcattagaaaaaatatcaggagaacttatatcaactcaaacaataaacgaaatactaaactacatactcgacaaaggaagcataacatataaaaaatttagatcatatataaacctctatgaaagtataaaatttaaaagcttaaaatacgacaaagataatgcagaaagtgcaaaattgatagatttcagaaaactagttgaatttaaaaaagctctaggtgaacactactttaacagacaagaacttgatcaaatttcaacttacataacactaataaaagacaatgtaaaactaaaaacagcattagaaaaatacaatctatcaaatgaacaaataaacaacttactggaaatagaattcaacgatcacataaatctttccttcaaagcattatcgatgattttaccccttatgaaagaaggaaaaaaatatgatgaagcatgtgaaatagccaatttaaaaccgaaaaccacaaaccaaaaacaagattttttgccagcattctgtaactcaatattcgtccacgaactatcaaatccaatcgtaaacagagctatcagcgaatacagaaaagtactaaacgcactacttaaaaaatacggaaaagtacacaaaatacacctcgaactcgcaagagatatcgggctatccaaaaaagccagagaaaaaatagagaaagaacaaaaagaaaaccaagcaataaatacatgggccctaaatgaatgcgaaaacatgggaataaaagcaaacgctaaaaacatactaaaactaaaactatggaaagaacaaaaagaaatatgcatatatagcggcaagaaaatatcaatagaacatctaaaagacgagaaagcacttgaagtagaccatatatacccctactcgagaagtttcgacgactcatacatgaacaaagtattagtattcaccaaggaaaaccaagaaaaattgaataaaacacctttcgaagcattcggaaaaaatatcgaaaaatggaacaagatacaaacactagcccaaatattaccatataaaaagaaaaacaaaatactagatgaaaacttcaaggataatcagcaacaagactttataagtaggaacctaaatgatactagatacatagcaaccctcatagctaaatacacaaaagaataccttaactttctaccattaaatgaaaatgaaaacataaatctcaaaagtggagaaaagggatcaaaaatacacatacaaacagtcaatgggatgctaacatcggtgctccgccatacttggggctttgacaaaaaagatagaaacaatcaccttcaccatgccctagacgcgatcatagtagcatactctactaattcattaatcaaggcattcagtgactttaaaaaaaatcaagagttacttaaagccaaactatacgcaaaagaacttacaaacgacaattacatccatcaagcaaaattcttcgaaccctttgaaggctttagagaaaagatactaaacaaaatagatgagatatttgtatcaaagccgccacgaaaaagagcacgaggagccctacacaaagagacattttactcagagaaaaaaatgataaaaaaatataactccaaagaaggactaaacatagcactagactgcggaaaaataagaaaaataggaacaaaatacgtagaaaatgatacaatggtgagagtagacatattcaaaaaacaaaacaaattctacgccatccccatatacaccatggactttgcactagggatactccccaacaaaattgtcgtaattggcaaagacaaaaataacaatccaaaacaatggcaagaaatcgatgaatcatacgaattctgtttttcactatataaaaatgatcttatcctattacaaaaaaaagatatgcaagaagcagaattcgcctactataacggattcgacattgactctagtcgaataaacataaagaaacacgacaataaattcgaaaacctcacaagtaatcaaaaactactattcacaaacaaagagaaaaacaggacaggaattcaaaatcttaaaatattcgaaaaatatatcgttacacccttaggaaacaaaatcaaagctgactttcaaccaagacaaaacataagtttaaaatccagcaaaaaaaatggcttatga

SEQ ID NO: 4898 - RNA, 2988 nt, synthetic construct
  misc_feature 1..2988: note = Cas9 variant
  source 1..2988: mol_type = other RNA
atgaaaatcctgggatttgacatcggaattaactcaataggctgggccttcgtagaaaacgacgaattaaaagattgtggcgtacgaatattcacaaaagcagaaaacccaaaaaataaagaatcactcgcactcccacgaagaaatgcacgatcaaaccgtcgaagactcaaaagaagaaaaagcagactgatagcaattaaacatatacttgcaaaagaacttaatctaaattataaagactatatagcaaatgacggagaactaccaaaagcctacgaaggtaaattaaccaatgtttacgaactaagatataaagcactcaaccaaaaactcgaggctaaagatttagcaagagtcattctacacatagcaaaacatagaggatacatgaacaaaaatgaaaaaaaatcgaatgacagcgaaaaaggcaaaatactcagcgctctaaaaaacaacgcactcaaactagaaaaatatcaatctgtaggagaatacttttataaagaatttttccaaaaatacaaagaaaacacaaaaaacttcataaaaatacgtaacacaaaagacaactataacaattgcgtactcgcttcagatcttgaaaaagaattaaaactaatactagagaaacaaaaagagttcggatattcatacaacgatgacttcatcaaagaaatcataaacatagcttttttccaaagaccactaaaagacttttcacacctagttggaagctgcacatttttcgaagaagaaaaacgagcttgtaaaaactcatactctgcctgggaatttgtagccttaagtaaaataatcaacgaattaaaacgattagaaaaaatatcaggagaacttatatctgcacaaactataaatgaaatacttaaccacatattagacaaaggaaacataacgtacaaaaaatttagatcatgcataaatctccatgagagcatagaattcaaatcactaaattatgataaagacaacgcagaatcagcaaaactcgtagacttcaaaaaactaatcgaattcaaaaaagcactaggcgaacactcatttaaccgacaagaacttgatgaaatcgcaacccatatcaccctcattaaagacaacgataaactcaaaacagccttagaaaaatataatctaaataacgagcaaataaacgcactcctagaaatagaattcaacgaccatattaatctctctttcaaagcccttaacttaatattacccctcatgagagaaggtaaaagatacgacgaagcctgcgaaatagtcaatctaaaaagcaaaacaagtaaccagaaacaagatttactccctgccttctgtgactccatttttagtcaagaactgtccaatcctgtggtaaatagagccatttcagaatacagaaaagtattgaatgccctactcaaaaaatacggaaaagtccacaaaatacacctagagctcgcacgagatgtaggactctccaaaaaagcacgtgaaaaaattgaaaaagaacaaaaagaaaacaaggagataaacgactgggcattagacgaatgcgaaaaatttggcttaaaagctaataacaagaatatactcaaacttaaactatggaaagaacaaaaagaaatttgcgcatacagtggcaagaaaatatcaatcgaacacctaaaagatgagaaagccttagaagtggatcacatatacccatactcaaggagcttcgacgactcctacatgaacaaagttctagtttttaccaaagaaaaccaagaaaagctaaacaagacacccttcgaagcatttggcaaaaatatcgaaagatggaacaaaatccaagcactagcccaaaacctgccctacaaaaaaaaaaataaaatacttgatgaaaacttcaaagataaacaacaacaagactttatttcacgaaatctgaatgacacacgatatatcgctaccttaattgcaaaatacactaaagaataccttaactttctaccgctcaatgaaaacgaaaatacaaacctcaaatcaggagaaaaaggatccaaaatacatgtacaaaccataaacggaatgctcacctccgttttaagacatacttggggttttgataaaaaagatcgaaacaatcacttacatcacgcacttgacgcaataatcgtagcctatagtacaaattcaataataaaagccttttctgattttaaaaaaaaccaagaactacttaaagctaaactttacgcaaaagaactaacgtcagacaattacaaacaccaagcaaaattcttcgaaccttttgaaggatttcgagaaaaaatactaaacaaaatagacgaaatattcgtaagcaaaccgccgagaaagagagcacgaggaacattacataaagaaacattttacccagaagaaaccatgataaagaaatacaactccaaagagggactaaacatagcactcaactgcggaaagatacgcaaaataggcacaaagtacgtagaaaatgacacaatggtaagattagacatattcaaaaagcaaaacaaattctatgctataccaatatacacaatggatttcgcactcggaatactccccaataaaattgtcatcgcaggcaaggacaaaaacaataacccaaaacaatggcaagaaatagatgagagttatgagttttgctttagcctctataaaaacgatctaatacttttacaaaaaaaagacatgcaagaagccgaattcgcatattataattcattcgacatagactcgagtcgaatcaacatcaaaaagcatgacaacaaattcgaaaaccttacagacaaccaaaaattactatttacaaatcaagaaaaaaacagaactggaatacaaaacctgaaaattttcgaaaaatacattgtaacacctttaggagacaaaataaaggcagactttcagccacgccaaaacataagtctaaaaacaagtaagaaatatggtttatga

SEQ ID NO: 4899 - RNA, 2991 nt, synthetic construct
  misc_feature 1..2991: note = Cas9 variant
  source 1..2991: mol_type = other RNA
atgatgggtaacttcacactcggattagatctaggaactaactcaataggatgggccctaatagattttgatgacaaccaacaacctcaaaatttaatagcttgcgggagtcgcatatttcaagaagcagtagaagccaaaactggcacacccaaaaatcacgcaagacgagcagcccgagccgccagaaagttagttgcacgacgaaaacaaaggaggacaaaattactaaatttattagtatgtcacgacctccttccacaagatgaagcagaaagaaacgcactcttactagataatcaagcaaacaatccataccagctaaggaaaaggggtctagatgaaaaactagaaccatttgcatttgggcgggccttataccatttagcccacaggagaggatttcaaagtaatagaaaagccgcatcagatgaagatggaaaagtaaaaacagcaatttcagcacttcgagcagaaatgcaaggccacactttaggagcctttctagctgatcaacccacacaaagaagaagatataccgacagagcaatgtatgcggaagaatttgaacaactatggtcaaaacaaacaatatttgcacccgaacaactaactcaagcactaaaggtagaaattaaaaatagtatattcttccagcgaccattgaaaagtcaaaaacatctagtaggcaaatgtacctttgaaccaacacgaaaaagagcagcaaaagcaatattactcgcgcaacactttcgtatactgcaggacgtaaatcatttagcagttaaaaatccaataacaagagaatttcgacctctgacacaagacgaacgaaacaaattagcagaagcattagataaacaaaagggaatgaattggtctgcagtaagaaaagtaataggatggaataagaaagattcgctacacgaaggagaaacttttaacctcgaagaggggaagaaagataaattaataggcaacagaacagcatgcgacctacgtggagcgttaggagacagatgggacgctttcacggcaccacaacaagacgacttagttacagatttactaaccatagataaccctgacggattccttaaaagaatgaaaacacattggggctttgacgacgctactgcagaagcattagctacgacagaattagagcctggatatgctaggctaagctcaaaagcgatgagggcaattttaccgcatctagagcaaggaatgatatactcagacgcatgtaaagccgcaggttatgatcactcaaatccaaatcaaagaacaataacagacaaattgggcttaccatcgaatgtccggaatccagtagtacaaaaagcactttttgagacaagaaaagtagtaaatgccatagtaagaaaatacggaaaacctgcggttatacgtgtcgaaatggccagagacatgaaattatcaaaacgacaaaaagaagaattacaaaaagaacaaaataaacaaaagaaagcaaacgaactagcagaaggaatcttaagaaaagaatttggtatacaacaaccagcaaggactgatatacaaaaatacaatctatggttagaatgtaaggaggtttgcccatatacaggcacagttataagcagagaaatgttatatagtccagaagtagatgtagaacacatattaccgtattcaagaagtctagacgattcatacatgaacaaaacactatgtatggccacatataatcgacaaacaaaattaaataatacaccttacgaaataggtcaaggagacccagtcgcttatgcagaaatatttcagagaatcaagacactaccattcccaaaaagaagacgctttgaacaaaaagaaatagagaccgacaaatttatagaaagacaattaaacgatacacgatacatatgcgtagaagtaagagactttctacaacaactaggtgccccagtagaagtatcaaaaggtgaagcgacagcaaaattaagaggaagatggaaattgaatactttattatcacccggcggtggtaacgaaaagaatagagcagatcatagacatcacgctatagacgcagttgttatagctctaacaaatcgatccttattccataaattatcacgactctcagcgcagagtatatcatttgataaaagccgtttcgacgtacccccaccctgggacgacttttatgacgatgtatacgaaaagattgataaagtcatcgtctcacacgcacctaccagaaaaataagtggagcattacacgaagctacagcatatggacattttaaagaagaaatagcagacccgaaaacaggtaaattctctattgaagacagattcgtttacagaaaacctctcactactttgacagcaaatgaagtaggtaaaatcagagatgctaaagtaagggagctagtagaagcccgattagcacaattcggaaacaactcaaaagctgcatttggagatccgaacgagccactgcttcatgccgacggaaaaaccccaataaggaccataagactaacaacaaacttcaacaaaactacaacacacgcaatccaaaaaggacaagatagagattataaattcttcaagtatggaaataatcatcacgtagaaataatagaacatgttgaaactggaaagagaaagggaatattcgtcaccgcaatggaagcagcaaggagagcaagaggtgtggcaaatactgaaaaatctaatatagtccaacgaaatcacggcgacggatggaaatttgttatgtccttagccgtcaatgacatggtacgtacagaagatacgcaagcaatatatagggttcaaaaactagatggaagtaataacagatttactctaaggagccataacgcagccacacttgatgataaacaaacaggcgtagacaagactccaaacctcttcaaaggtaccaaaataatagtagacccattaggcaatcttacacagtgtaatgattga

SEQ ID NO: 4900 - RNA, 2994 nt, synthetic construct
  misc_feature 1..2994: note = Cas9 variant
  source 1..2994: mol_type = other RNA
atgaaagttctagtagatgcaggattaatgcccagtgatccagcagctgcaaaagcattagaaacactagacccctacgaattacgagctactggtctagatgtaatgctaccactaacacacttagggagagccgtttttcacctaaatcaaagaagaggatttaaaagtaatagaaaaacggatagaggagataatgaatcaggaaaaataaaagatgcgacaaaaaggttaacttgggcaatgcaagaagctggggccagaacatatggagaatttcttcacatgagaagggcacgggcaagtgatccaaggcaggtaccaagcgttagaacaagattaagtgttgcgagcaggggaggacccgatagtaaagaggaagcagggtatgatttttatcccgagcgcgcgcacttagaagacgaatttcacgcactatggagtgcccaagctgccttccaccctgatctaacgtgtgaattacgcgatgtagtgtttgagaaaatattttatcaaagaccattaaaagaaccaaaggtaggcttatgcttatttacagctgaagaaaggttacctaaagcccatccgttgactggtagaagagtattatacgagacagtaaaccaattaagagttactgcagacggaaggacaacaagacccctaacattagaagaaagagacatgattgtatacgcacttgacaataaaaagcctgtaaagtcattgagcagcatgcatctaaaattagttgctcttggtaagctagtgaaactaaaagacggtgaacgatttacattagagtcaggggtaagagatgcgatagcatgtgatcctatacgagcaacaatgggtcatccagatggattcggaccagcttggagtaggctggactggcaagctcaatgggcactaatagaaaaattacgtcaagttcaaagtgatgatgattttgcttctttagtagcctggttaggcgcaacacataacttgtcagaagatcatgcaaaaagagtagcaaatttacacctacccgaaggttatggaaggttgggcttgaccgcaaccgaagcaattctatgtaatctaaaagctgaggtatgtacgtattcacaagcagtggaaagatggggcaaacaccattcaaaccaaaggacaggagagtgtttagaagctctgccatattatggagaggtattagatagacatgtcatacctggaacatataacgaagacgacgatgacgttacacgatatggaagaataacgaatccaacagttcatatcggtcttaaccaactaagacgattagttaatagaataattgcaacttatggcaaaccagatcaaatagtcgtcgaactcgcaagagaattaaaacaatcagaagcccagaaaagcgaggccctaaagaaaataagagatacaaccgcagatgcgataagaagaggacgacaactagaagagataggtcagaaaaatacaggtgccaacagactattgttaaggttatgggaagatttagggcccgctgtaggtcctagatgctgcccctatacaggaaaaccaatatcagttacgatgttatttgatggagcatgtgatgttgatcacattttaccatattcacgcacactagacgactccttcgctaaccgtacaatatgtttaagagaagctaacagacaaaaaggcgatagaaccccatgggaggcgtggggtggatcggatcaatgggatgcaattgaagcaaacttaaaagatctaccggaaaataaacgaaaaagattcgcacctgatgctatggaaagatttgaaggagaaagagactttttagatagagctctagtggatacgcaatacctcgcaagaataagcagggcgtatctcgacacacttttcacagaaggcggtcatgtatgggtagttcctggaagaatgacagaaatgcttcgccgacattggggtctgaacgcattactaagcgataaagatagaggagccggaaaagttaaaaacagaacagatcatcgacaccatgcaatagatgcagcagtaattgcagcgacagatcacagtttagtaaacagaatctcaaaagcagcaggacaaggtgagtcagcagggcaatccgcagaattaatagcacgtgacacacccgaaccttgggaaggatttagaaatgacataagtgcacaaattgcgcgtattgtggtatcacatcgagcagatcatggaagaatagatgtagaaggaagaaagcatggaaaagatagtaccgcaggaagactacacaacgatacagcctatggaatagtagatgatcatacggtagtaagtagaacgccactcttatcacttaaacccggagatatagaagtaaccaccaaaggtaaaaacattagagatacacaactacaaaaagcgttaagtgtagctacaacaggaaaagatggaaaaggatttgaagaagcgttaagaaactttgcagaaaaagaaggaccttatcaaggcataagaagagtaagattaatagaaacattacaaagtagtgcgagagtagaggtaggatcagatgaagatggacaacctttaaaagcatacaagggtgatagtaaccactgttacgatctgtggaagctacctgatggtaaagtggtaccccatgtagtcagcacttatgaagcgcacgccggcacagacaaaagacctcatccagcagcaaaaagaatattaagagtatttaagaaagatatggtggctattgaacaagatgatcaaacagcaatcttttatgtacaaaaattagatagagcaaatggtctctttctggcaccacatttagaagcaaatgctgatgcacgacatagaaatcccaatgatgcctttaaatttctccaaatgggagcggggagcgtcgtaagaaataaactgaggcgagtatacgtagatgaaatagggagaataaaagatccaggtccaccaaaacattga

SEQ ID NO: 4901 - RNA, 2994 nt, synthetic construct
  misc_feature 1..2994: note = Cas9 variant
  source 1..2994: mol_type = other RNA
atgaaaatattaggattcgacataggaattaatagtattggatgggcatttgttgaaaacgatgagctaaaagattgcggggtcagaatctttacagaagctgagaatccatcaaataaagaaagcttggcacttccaagaaggaacgcaagatcaagtagaagacgtttaaaaagacgaaaagccagattagttgcaatcaagcgaattcttgccaaagaactaaaactaaattttaaagattatgtcgcagcagacggagagctgccaaaagcatacgaaggtaaacttacttctatctacgaactacgctacaaagcattaatacaacagttagaaacaaaagatctagccagagtgatcctccatatcgcgaagcacagaggctatatgaacaagaatgaaaaaaagagtaacgacaccaaaaaaggtaaaatactcagcgcattaaaaaacaacgctctaaagctcgaaaattaccaaagcgtgggtgagtatttctataaagaattctttcaaaaatataaagaaaacacaaaaaatttcattaaaataaggaatacaaaagacaactacaacaactgtgtactgtcatccgatctagaaaaagaattaaaactaatattagaaaaacaaaaagaatttggatacaattattccgaagacttcattaacgaaatattaaaggtggcattcttccaaagaccactaaaagacttcagtcacttagtgggagcatgcacattcttcgaggaagaaaaaagagcatgcaaaaattcatacagcgcgtgggaattcgtagcattaacaaaaatcataaacgaaatcaaatcattagaaaaaatatcaggagaaatagtaccaacacaaaccataaatgaaatactcaacttaatattagacaaaggtagcataacctacaaaaaattcagatcatgtataaacctacatgaatcaatatcctttaaatcccttaaatatgataaagaaaacgcagaaaacgcaaaactaatagacttcagaaaactagtagaattcaaaaaagcactaggagtacactcattatcaagacaggaactggatcaaatctcaacacatatcacactaattaaagacaatgtaaaactaaaaaccgttctagaaaaatataatttatccaatgaacaaatcaataatctcctcgaaatagaattcaatgactatataaatttatcttttaaagcccttggcatgatcctacccttaatgcgtgaaggaaaaaggtactatgaagcatgcgaaatcacaaacctaaaaccaaaaaccgtcgatgaaaaagaagatttccttccagctttctgcgattcaatcttcgcccacgaactaagtaatcctgtcgtaaatcgcgcaatctccgaatatagaaaagtcttaaatgcactccttaaaaaatacggaaaggtacacaaaatacatctagaactagcacgcgacgttggattaagcaaaaaggcaagagaaaagatagaagatcaacaaaaaaacaacaaagcaataaacgactgggcactaaaagaatgcgaaaacatcggaattaaagcaagcgctaagaacatactcaaactaaaattatggaaggaacagaaagaaatatgcatatattctggaaacaaaatctcaatagaacatctaaaagatgaaaaagccctcgaagttgaccacatctatccatactctagatcttttgacgactcattcataaataaggtactcgtctttacaaaagaaaaccaagaaaagctaaacaaaacaccatttgaagcattcggaaaaaatatcgaaaaatggagtaaaatccaaactttggcacaaaatctcccctataaaaaaaaaaataaaatcttagacgaaaatttcaaagataaacaacaacaagacttcatatctagaaacttaaacgacacaagatatataacaaccctaatagcaaaatacacaaaggaatatctcaatttcttgcccttaagcgaaaacgaaaacaccaacctaaagtcaggagaaaaaggcagtaaaatccacatacaaacaatatctggtatgctaacctcagtcttaagacacacatggggattcgacaaaaaggacagaaataatcatttgcaccacgcattagatgccataatcgtagcatactctacttcatcaatcataaaagcattctccgactttaaaaaaaatcaagaattattaaaagcacgattctacgcaaaagaactaacatcagacaactacaagcatcaagtcaaattttttgaaccattcaaagggtttagagaaaaaattctaagtaaaattgacgaaatattcgtttcaacacccccacgtaaacgagcaagaggcgctttacacgaagaaacattctattcggaagacaaaatgatcaaaaagtataattcaaaagaaggattacaaatagctttatcatgcgggcgagtcagaaaaatcggaacaaaatatgtagaaaacgacaccatggttcgagtagacatattcaaaaaacaaaataaattctacgcgatcccaatatacgtgatggacttcgcactaggaatcctacccaacaaaatagtaataacaggaaaagacaaaaacaacaatccaaagcaatggcaaacaatagacgaatcttacgaattttgtttttcattatacaaaaacgacctaatactgctccaaaagaaaaacatgcaagaaccagaattcgcatattataacagtttcgacatagatagatcaaggataaaaataaaaaaacacgataacaaatttgaaaacttaacaagcaaccaaaaactactatttacaaacaaagacaaaggcaaaaaccgaactggcattcaaaacctcaagatattcgaaaaatacatagtaacaccactaggagataaaattaaggcagacttccagccccgcgaaaatatatcattaaagacttctaagaagcatggcctatga

SEQ ID NO: 4902 - RNA, 2994 nt, synthetic construct
  misc_feature 1..2994: note = Cas9 variant
  source 1..2994: mol_type = other RNA
atgggtaattacacattaggattggatattggtagcaattcaattggatgggcattagttgaagatgcggtcgaggcaccacgcatagtagatatgggagtgagagtatttccggaaggcgtggaccgcgacacgaaaggattggaaaaatcgaaaaacgcaacgaggagagaagcacgtggcgcgagacggacacaccagagaagaaggcaaagaaaacaaagacttgtgagagcactaagacaagtaggtctactgccatgtgacaaggccgaagtaagaagcctgtttcagaccgacccttacgaaataagaaaaagaggtttagaccatagattagaactctatgaaataggaagggcattttatcacctatctcaaagaagaggattcaaaagtaatagaaaatcaggcgctctcaaagaagacggaacggtcaagaaagaagctggagagttgcaaagaaaaatagatgaggcaggatgtagaactatcggagaatattttgcaggcctagacccagaacagcaaaggatccgcggcagatatactttcagaagtatgtaccaaaaagaatttgatctactatgggctaaacaagtagaattttatccgaaagtattaacagaggatttaagatcaaaagtacgcgatgaaataatcttctttcaaagaccactaaaaagcgccaaagacttaataggagattgtgaactagaacccacagaaaaacgatgtcctcgagcagattggtatgcaaggagatttagattactacaagatattaataatttaataatacaaaatccggacggtacagaacagaaactaagtccagaccaacgagcagcactgcttggcgaactaggacaaagagaaaaactaaccttcgataacataagagcaaagctaggattattagaaacgcaaaaatttaatgccgaatatagaattggtagaaaaggtaagaaagtagaagcaataaaaggcgacgtatttgtctggactatgaggggaaaatcggtttttggaccaaaagcctgggatgcaatggctgatgaaagaaaagttagcttaaatgaattgtttgtagagttagaggacgatgatttagctagaaaattagagaccgaatatggcttaacagataaacaagtacaagcagcaatgaaggcttctctcccacaaggatacatgagtttctcaagaaaagcagttttaaaactcctaccatttatggaggcaggagcattaactcatgaagccatagatcaagcaggatatagaaaagaagaaccaacacaaacagatgcaatagcaagagtaagttttcctccagatctgagaaatcccatagtgcaaaaagcattattcgaggtgcgaaaagtggtcaacgccctagtacgagagtatggaaaaccgacaagaatcaaaatagaaatggcacgagacgttcaaggtagcaaaaggcaaagagaagaattgcattggcgaaatgaagataacagaaagaaaaacgaagaagtacgtgacagattaagaactgacatacacatagacgatcctagcagagacgatgtaattaaatataaactatggcaggaaagcggtaaaatgtgcccatatacaggaagacaaatatgtcaagaagcgttgtttggacccaatccagagttccaagtcgaacatatcctaccgtatgacagatctctagatgattcctacatgaatttaacattatgcgaagttcatgaaaacatacatggcaaaagaaatcaaacaccatttgaagcatacggaagtggagcagaacgatatgaacaaataaagcaaagaattaaagtcttaccttggccgaaaagacagaaattcttgcaacaagaaatcaatctagatagccatataagcagggaacttaatgatacaagatacatatgcagagaaacagtagcatatctaaagcaactaggagtccatgtaaggggaacaagaggaaaaataacagcagaattaagacatcaatggggattagatggaattttcagtgaattaggtgtacgaagagatgatgaccaccgacgacatgcagtagacgcattggtcgtcgctgtcaccgataatgaacatttacgtcgattagcggtgagtaaatacgtattagcaggcccaaggtttgaaacaccgtggagtgccttcagagatgaagcaagaggtaacgtaaagagaatgaatgtatcgcatcgagtttgtagaaaagttagtggtgcgctacatgaagagacaaactacggaccgacgggcgtacgagatcaagcaggacaagatatatacgcgtatagaaagaaactagaagacttaacaaccccaatggtagagaaaatagtcgatcctgtcgtacgagacatagttagacaaagattattaatgaagggaatagaccctgcagctgcagacagaaaaataccaaaagatgtatggaaagaaccactatacatgcgtagaacaaaatcagataaaatgatacaaataagaagagttagaatacacgatgttaaaaactctattattgtattgacagacgaatcaggccgaccatatagagcagtagaaccaggaggaaatcaccatgtcgaggtattcgagtacgtacacgggacaaaaactggtacccgagaagccgaagtagtaacaatgtttgaagctgtccgaagatcaagggcaagagcaccagtggtgagaagagatcacggtccaggtacaaggttcgtatgctctttagcaataaatgacatggttatgatgcccgacaaaagtggaaaaatggatctctttagaatacaaaagatgtcagccagcaaacaagtatactttagacatcatacagcggctcgaatcgacagcgaaagaacattaataagaaaacaagcccatctattcaatggatataaagtgtctgttgaccctactggagcaatttgtagagcaaatgattga

SEQ ID NO: 4903 - RNA, 3000 nt, synthetic construct
  misc_feature 1..3000: note = Cas9 variant
  source 1..3000: mol_type = other RNA
atgaaaatactgggattcgatataggaataaactccattggatgggcatttgtagaagacaatcaattacaagattgtggagtacgcttatttacaaaagcagaagatccaaaaaccaaagagtcactggcactacctagaaggaacgcaagatcaaacagaagaagattaggccgcagacgatcacgactaattgcattaaaacatataattagcaaagggctaaaactaaactaccaagactacatagctaacgacggagaactaccaaaagcttatgaaggacgcttaatatctccatacgaactccgttataaagctctaaatgaaaaaatcgaaccaaaagacctagcacgagtaatactacacatagcaaaacaccgaggctacatgaacaaaaacgaaaaaaagtcatcagacaacgaaaaaggtaaaatactaagcgcattaaaaacaaacgcactaaaactagaaaaataccaatccgtaggagaatacttttacaaggagttctttcagaaataccgagaaaacacgaaggacttcataaatataagaaataaagaaggaagctatgaaaattgtgtattagctagtgacttagagaaagaattaaaattgatcttggaaaaacagaaagaatggggatactcctataatgataacttcataaaagaaattttaaaagtagcatttttccaaagacctctcaaagacttttcttatctcgtaggagcatgtacattcttcgaagacgaaaaaagagcttgcaaaaatagttactctgcatgggaattcgtagcactaaccaagataatcaatgaactcaaatcattagaaaaagaaagcggagaactggtgtcatcacaaatcataaacgaaatactaaatcatatattagataaaggcagtatcacttacaaaaaattcagagaatatataaaactacatgaatcaatgaaattcaaaagtctcaaatacgataaggataatgtcgaaagcacgaaactaatagaatttcgaaaactagtagagtttaaaaaagcactaggtgagcactccctctcaagagaagaacttgaccaaattgccacatacataacactcataaaagataatgaaaaattaaaaataacattagagaaatactcactaaacaatgaacaaataaaaaacctcctagaaatagattttaacgatcatatcaacctaagcttcaaagccctcaatctgatactaccattaatgaaagaagggaaaaggtacgacgaagcatgcaaactgctaaatctaaaaacaaaatccaataatcaaaaatttgattttctacccgcattttgtgattcaatatttgcccaagaattaactaacccaatagtgaacagagcaataagcgaataccgaaaagtactaaatgcactactaaaaaaatatggcaaaatgcataaaattcacatagaactagctagagatataggattatcaaaaaagctcagagcaaaaatcgaaaaagaacaaaaagaaaactacgagaacaacatatgggccctaaatgaatgcgaaaaattcggtctaaaagcaaacgcaaaaaacatcttaaaattaaaactttggaaagaacaaaaagaattttgtatatattccggaaaaaaaattagcatcgagcaccttcgagacgaaaaagcgttagaagttgaccatatttacccatactcaagaagcttcgacgactcattcctaaacaaagttttagtcttcacaaaagaaaaccaagaaaaattaaacaaaacaccctttgaggcattcggggctaatgaagaaagatggagtaaaatacaggcgttagcacaaaacttaccatacaaaaaaaaaaataaaatactggatgaagcatttaaaggaaaacagcagcaggattttatctcgcgaaacctcaacgacaccagatatatatcgacacttatagttaagtacacaaaagaatacctagacttcctacccttagatgaaaaagaagatgtcaacctcaaatcaggagaaaaaggatcaaaaattcatgtacaaacaataaatggcatgcttacatcagttctgagacacacatggggatttgcacaaaaggatagaaacaaccacctgcatcatgccctagatgccaccatagtagcctactcaacaaacgcaataataaaagcattctcagactttaaaaaagaacaagagctactcaaagcaaaactttatgctaaagaactgacaagcgattcatacaagcaccaggcaaaattttttgaaccattcgagggttttagagaacaaatacttaaccaaataaacaaactatttgtctcaaaaccaccaagaaaaagagcacggggagcacttcataaagaaacgttttactcaaaagacgaaatgataaaaaaatacaattcccaagaaggagtagaaatagccttaaactgcggaaaaataagaaaaataggaacaaaatacgtagaaaacgatacaatggtccgaatcgatattttcaaaaaacaaaataaattctacgccatacctatatacaccatggactttgcattgggcgtattaccaaacaagatagtaataataggaaaagacaaaaaaggaaatcctaaacaatggcaggaaatagatgaatcatatgaattttgctttagcttgcacaaagacgacttagtacttattcaaaaaaaagatatgcaagaaccagaattcgcttactacaacggcttcgacattagtaatagctcaatctgcgtagaaaaacatgacaacaaattcgaaaatctaacagacaatcaaaggttattatttactaacgcagaaggaaatgtcaaagcaaaaaaaataggaatccaaggactacgaatattcgagaaatacatcataacaccccttggtgaaaagataaaagcagactttaaaccaagagaggacatagcattaaaaacatcaaaaaaacacggattatga

SEQ ID NO: 4904 - RNA, 3003 nt, synthetic construct
  misc_feature 1..3003: note = Cas9 variant
  source 1..3003: mol_type = other RNA
atgaagatattaggattcgatataggtataaattcaataggatgggcattcgtagaaaacgacgaactcaaagactgcggagtaagaatattcacgaaggccgaaaatccaaaaaacaaagaaagcctagcactaccacgcagaaatgcacgctcttccagaagacgactcaaaagaaggaaggcaagactaatcgctataaaaagaatcttagcaaaagaactcaaattaaacttcaaggattacgtcgcagcagatggagaactaccaaaagcctacgaaggctctttagcatctgtatacgaactcagatataaagcactcacgcagaaattagaaacaaaagacctagcaagggtaatactacatatagcaaagcatagagggtacatgaacaaaaacgaaaaaaaatcaaatgacgcaaaaaaaggaaaaatactatctgccctaaaaaataatgccctaaaattagaaaattatcaaagcgtcggcgaatatttttataaagagttctttcagaagtacaaagaaaatacaaaaaactttataaaaataagaaacacaaaggacaactataacaactgtgtcctctcttctgacctagaaaaagaactcaaattcatcttagaaaaacaaaaagaattcggctataagtattctgaaggcttcataaacgaaatactgaaagtagcgttttttcaacgaccgctaaaagacttttctcaccttgttggagcctgcaccttctttgaagaggaaaatcgagcatgcaaaaactcctattcagcatgggaattcgtagcattgacaaaaataataaacgaaatcaaatcgctagaaaaaatatcaggagaaatagtatctacacaaacaataaatgaagtgctaaacctaatattagacaaaggctccataacatataaaaagttcaggagctgcatcaatctccacgaatcaataagctttaaatcgttaaaatacgacaaagaaaacgccgaaaatgcaaaactaatagactttcgcaaactcgtggaattcaagaaagcattaggcgtgcattccttatcaaggcaagaattagatcaaatatccacacacgtaacattaataaaagacaacgtaaaactaaaaacagtactagaaaaatacaacctatcaaacgaacaaatcaacaatctattagaaatagaatttaatgattatatcaacctttcatttaaagccttagggatgatattacccctcatgcgagaaggtaagagatatgatgaagcatgcgaaattacaaatctcaaaccaaaaaccgtagacgaaaaaaaagattttctaccagcattctgcgacagtatctttgcacacgaactttcaaacccagtagtaaacagagccataagtgaataccgaaaagtactaaacgccttgttaaaaaaatacgataaagtccataaaatccatttggaattagcaagggacgtaggccttagcaaaaaagcacgggaaaaaatcgaaaaggaacaaaaagagaaccaagcagtaaacgcatgggctctaaaagaatgtgaaaacatcggtctcaaagcctcggccaaaaatatactaaagcttaagctatggaaagagcaaaaagaaatttgcatctactcaggaaataaaataagcatagaacatttaaaagacgaaaaagcgctagaagtagaccatatatatccatatagtcgtagtttcgacgacagttttatgaataaagtattagtattcactaaagaaaatcaagaaaaactaaataaaacaccttttgaagcctttggaaaaaacattgaaaaatggtcaaaaatacaaacactagctcaaaatttaccatacaaaaaaaaaaacaaaatattggacgaaaactttaaggataaacaacaagaagactttatatccaggaacctaaacgacacaagatacattgctacgctaataaccaaatatacaaaagaatatctaaatttcttacctctcaatgaaaatgaaaataccaatttaaaatcgggagaaaaaggtagcaagatacacgtccaaacagtcaatggtatgctcacctcagtactaagacatacatggggattcgacaaaaaagaccgtaacaaccatctacaccacgccctcgacgcaatcatagtagcatacagcacaaactcaataataaaagccttctcagacttcaaaaaaaaccaagaactactaaaagcacggttttatgcaaaagaactaaccagcgataattacaagcatcaagttaaattcttcgaaccctttaaaggttttagagaaaaaatcctctcaaaaatagatgaaatcttcgtatcaaaaccacccaggaaacgagctagaggcgcgttacacaaagaaaccttttactcagaagacgagatgataaaaaaatacaactcgaaagaaggtctgcaaattgccctttcatgcggccgagtaaggaaaataggtacaaaatatgttgaaaacgacacaatggtcagagtagatatatttaaaaagcaaaacaaattttatgcaataccaatatatgcgatggatttcgcactaggcatattaccaaacaaaattgtagtagtaggcaaagataaaaataataaccctaaacaatggcaaactatagatgaaagttatgaattctgtttctccctgtacaaaaacgatttaataatgcttcaaaaaaaggacatgcaagaagcagaattcgcttattataatggtttcgacatctcaacatctagcatctgtgttgaaaaacatgactcaaaatttgaaaatctcacaagtaatcaaaaactactattttccaatgctaaagaaggaagcgtaaaagtagaaaacctcggaatacaaaacctaaaaatattcgaaaagtacataataacaccattaggcgacaagatcaaagcagatttccaaccacgcgaaaacataagtctcaaaacaagcaaaaaaaacggtttatga

SEQ ID NO: 4905 - RNA, 3003 nt, synthetic construct
  misc_feature 1..3003: note = Cas9 variant
  source 1..3003: mol_type = other RNA
atggcaagggctcagagacgtttaatatccagaagagccaacagaatgaataaactgagaagattattaaaacaagaaaatgttttacaagctaacgattatgacgaaaaaggcctaattataggactacccaatcaagcatgggaacttcgcgcacaaggcctagatagaaaattagaaccaaaagaatgggccgctgtgttaataaacctcgtaaaacatagagggtatttaagtcaacgtaaaaatgaatcacaaacagcagacaaagagctaggagccctattaagtggaatgaatcataatcatcaactgctacaatcacaaagtaatcaatacagaactccagcagaattagcaataaaacaatttgcgacacaagatggacatattagaaaccagagaggagcatacacacacacttttaatagattagacctacaaaacgagttaaatcagctattcgacgcacaaacaagacttggcaatccacacgtaagtggatccctcaaaaccgcgataaatgacttactaatgaatcaaaaagcagcattatctggcgacgcgatccttgaaatgctaggacgatgtacattcgaaccatcagaatataaagccgcaaaaaatacctacagtgcggaaagatttgtatggctcggcaaacttacaaacttaagaatacaagataatggattagaaagcgccctttcaagagaacaaagggaactactacttaatgaaccatataacaaaacaaaactaacataccaacaggttcgaaaactactacggctaccagaaacagcctttttcaaaggtctaagatatggtaaagacaacgcagaatcagcaacattcatggaaatgaaatcataccacgcaataagaaaatctctagaaaacaaaagtctcaaaagtgaatgggaaaaactaaaaactcagccaaaactccttgatctaattggcactgcattcagtatatataaaacagatgatgaaattgccggatgtctaaaaaatcagctcccagaaaatgttataattgcgctacaagaacaattaaatttcagcaactttatggaattgtccttaaaagcactagaaaaattgctaccactcatggaacaaggtttgcgatacgatgaagcatgcacgcaaatttacggtaatagacacgaaaaaatagccgataaaacagagaaattcctcccaaacataccggctgacaaattacgcaaccctgtcgttttaagaacattaacacaagcaagaaaagttataaacgccatcattcgaagatatggtagcccagccagggtacacatagaaacaggtagagaagtaggaaaatccttttcagacagagacaaactcaaaaaacagcaagaagaaaatcaagaacaaagaagacgcgcaatagacgaatggaaacaattttttccaaacgcagctcacgaaccaaaagcagtcgatattctaaaattaagactatatcaactacaacagggtaaatgtctttatagcgggcttccaatcgacgtcagaaggctaccagaaaaaggatacgtagaaatagatcacgcactaccattttccagaacatgggatgactcattcaataacaaaatcctagtactagcctcagaaaaccaaaataaaggcaatcaaacaccttacgaatacctcagaggagcagacaactccgaaagctggcgactttttgttgaaaatgtacaaaactgccaatttagtccaaataaaaagcaaaaaataatggcaaaacagctagatgaaaaaggatttttagaaaggaacctcaacgacacgcgatatgtcagccgctttttatgccaattcataagtgaacatctgcatttaacaggtaaaggaaagaaacgagtttttgcctctaatggccaaataactgcactattaagaggaagatggggattatcaaaaaatcgtgaagaaaatgataggcatcatgcagtagacgctgtcgtagtggcatgtagcacggttgcaatgcaacaaaaaataacacaattcgtcagatatcaaaaaggaaatgtctttactggagaacgaatagacaaagaaacaggagaagtaatatccatccatttcccaactccctgggaacacttcagagaagaagtcatgatccgagtattcgacgataatccactacgcacattaccagaaaagttacccaacaggcccgaagctctacacgaatacgttatgcctctatttgtaagtagaatgccaacaaggaaaatgacaggacaaggacacaaggaaacaataaaatctgccaagcgcctcgatgaaaaaataagcgtattaagagtaccacttacccaactcaaattgaatgacttggagaacatggttaacagagaaagagaaccagcactatatgaagctctaaaagcacgtctagaacaatttaaaaacgatcctgcaaaagcttttgctgaaccatttttcaaacaaggcggacaacaagtcaaagcagtaagagtcgaaatagtacaaaaaagtggcatgctattacgtaaaataaatggggtcgccgataatggatcgatggtaagagtagatgtattcgaaaaaagtggaaaattttacctagtacccatctacgcgtggcaggttgcagaaggtatactcccaaactatgcagtcgtcgcacacaaagatgaaagcgactggatattaatggatgaaagttatcactttaaatttgcattatataaaaatgacctactagaagtccaaacaaaaaaaggtggtataatgggatatttcgcaagcttagatcgagcaacgggcgccatcacaataagagaacacgatcgtgataaaaaaaaatgcaaagatggcgagcatcgatcaataggagtgaaaatggcatcatcctttaaaaaacttcaggtcgatgaacttggcaaaaatatacacgaaacaagaagtcgaaaaagacctaatataggatga

SEQ ID NO: 4906 - RNA, 3012 nt, synthetic construct
  misc_feature 1..3012: note = Cas9 variant
  source 1..3012: mol_type = other RNA
atgcgaattctaggttttgatattggaataaactctatcggatgggccttcgtagaaaacgacgaactcaaagattgcggagtgagaatattcacaaaagctgaaaacccaaaaaacaaagaatcactagcactccccagaagaaacgcaaggtcatcacgacgacgattaaaaagacgaaaagctcgactcatagcaatcaaaagaatactagcaaaagaactaaaactaaactacaaagactacgtggctgctgatggagaattacccaaagcatacgagggatcactagccagcgtctacgaacttcgctacaaagcactgacacaaaatctagaaacaaaagatctcgcacgagtaatactccacatcgcaaaacatagaggatacatgaataaaaacgaaaaaaagagtaatgacgccaaaaaaggaaaaattttatcagcactaaaaaacaacgcactaaaactcgaaaactatcaaagcgtcggagagtacttttataaagaattcttccaaaagtacaaaaaaaatacaaaaaatttcattaaaatcagaaacactaaagataactacaacaattgtgtattatctagcgatttagagaaagaactaaaacttatccttgaaaaacaaaaagaatttggatacaattactccgaagactttatcaacgaaatactaaaagtcgcattcttccaacgacccctcaaggactttagccacctagtcggagcatgcacattttttgaagaagaaaaaagagcctgtaaaaactcttactcagcctgggaatttgtagccctaacaaaaataataaatgaaataaaatctttagaaaaaatcagcggagaaatcgttccaacacaaacaataaacgaagttctcaacttaatactcgacaaaggttcgataacctacaaaaaattcagatcctgcatcaacttacatgaatcaatctcattcaaatcactaaaatacgataaagaaaacgcagaaaatgcaaaactaattgattttcggaaactagtagaattcaagaaagcactaggtgtccattctctatctagacaggaactagatcaaatatcaacacatataacactaataaaggacaatgtaaaactaaaaacagttcttgaaaaatacaatctttcaaatgaacaaataaataacctactagaaatagaattcaacgactatataaacctctcattcaaagccctaggaatgatcctacccctcatgagagaaggcaaacgatacgatgaagcatgcgaaatcgcaaaccttaaaccaaagacagtggacgaaaaaaaagatttcctccccgcattctgcgatagtatcttcgctcatgaactctcaaatcccgttgtcaaccgagcaataagcgaatacagaaaagttttaaacgctctccttaaaaaatacggcaaagttcacaaaatccacctagaactagcacgtgatgtaggactttcaaaaaaagcacgagaaaaaatcgaaaaagaacaaaaagaaaatcaagcagtaaacgcatgggcgcttaaagaatgcgaaaacataggattaaaagcatcagcgaaaaacatactaaagctaaagctatggaaagaacaaaaagaaatatgtatctatagcggcaacaaaataagtatcgaacacttaaaagacgagaaagctctagaagttgatcatatatatccatactctagaagtttcgatgacagtttcattaataaagtactagtatttactaaagaaaaccaagagaaactaaataaaacccccttcgaagcttttggcaaaaacatcgaaaaatggtccaaaattcagacccttgcacaaaacttaccctacaaaaaaaaaaacaaaatcctagacgagaactttaaagacaaacaacaagaagactttatatccagaaacctcaatgacactagatatatcgcaaccctgatagcaaaatatacaaaggaatatctaaactttttactcctatcagaaaatgaaaatgcaaaccttaaaagcggagagaaaggaagtaaaatacacgtacaaacaataagcgggatgttaacatcagtactccgacacacatggggattcgataaaaaagatagaaataaccacctacaccacgctctagacgctataatcgttgcttacagcactaacagcatcataaaagcattctcagatttcagaaaaaaccaagagttactaaaagcccgattttatgccaaagagctaaccagcgacaattacaaacatcaggtaaaattcttcgaaccattcaaaagctttcgagaaaaaatactctccaaaatcgatgaaattttcgtaagcaaacctccccgtaaaagagcaaggagagccctccataaagacacattccattctgaaaacaaaataattgacaaatgttcttataactcaaaagaaggactacaaatagcattaagttgcggtcgagtacgcaaaattggcacaaaatatgtcgaaaacgatacaatcgtccgagttgacatattcaaaaaacaaaacaaattctacgctatcccaatatatgccatggacttcgcattaggtatactaccaaacaagatcgtaattaccggaaaagacaaaaacaataacccaaaacaatggcaaacaatagacgaatcgtacgaattctgcttttccctatacaaaaatgacctaatattactgcaaaaaaaaaacatgcaagaacctgaattcgcatattacaatgacttcagtatatcaacatcatcaatttgcgtcgaaaaacacgataataaatttgaaaacctcacatcaaaccaaaagctattattctccaatgcaaaagaaggatctgtcaaagtagaatccttaggaatacaaaatctaaaagtattcgaaaagtacataataacacccctcggcgataaaataaaggcagacttccaacctagagaaaacattagcctaaaaacctcaaaaaagtacggcttaagatga

SEQ ID NO: 4907 - RNA, 3012 nt, synthetic construct
  misc_feature 1..3012: note = Cas9 variant
  source 1..3012: mol_type = other RNA
atgatagacgagagcttgacctttggcatagatttaggaatagggtcttgcggttgggcggtacttcgcaggcccagtgcctttggaagaaaaggggttatagaaggaatgggttcatggtgtttcgacgtaccagagacaagtaaagaaagaactccaacaaatcaaataagacgatctaatagactattacgtagagtcatcagaagaagaagaaacagaatggctgcaataagaagactgctccacgcagcaggtctactaccttcaactgactccgatgctttaaaaagaccggggcacgacccgtgggaactaagggctagagggctagataaaccactcaaacctgtagaatttgcagtcgtattgggacacatagcaaaaaggcgaggatttaagtcagctgctaaaaggaaggctacaaatatatcatccgatgacaagaaaatgttaacggcactagaagcaacacgtgaaaggctaggtcgttatcgcaccgtaggtgaaatgtttgccagagaccccgattttgcatcaaggaggagaaatagagaaggaaagtatgaccgtacaactgcaagagatgacttagagcatgaagtacatgcattattcgctgcccaaaggcgacttggacaaggattcgcaagtcccgaactagaggaagcgtttactgcaagtgcatttcaccaaagacctatgcaagattcagaaagattagtaggattctgcccttttgagaggactgagaaaagagcagcaaaactaactccaagttttgaaagattccgactattagctaggttgctaaacctgagaataacaacaccagatggagaaagaccattaacagttgatgaaatcgctcttgtcaccagagatttaggaaaaacagcaaaattaagcattaagagagttagaacattaatagggctagaagataatcaaagatttactacgattcgacccgaagatgaagatagggacatagttgcaaggaccggcggagctatgacaggcaccgctacattaagaaaagcactaggagaggcattgtggacagacatgcaagaaagaccagaacagttggatgccatagtacaagtgctcagcttctttgaagcaaatgaaacaataacagaaaagttaagggaaataggattaacacttgctgttctcgatgtattactgacagccctagatgcgggggtttttgctaagttcaaaggagctgcacatatatcaacaaaagcagcacgaaacttattacctcacctcgaacaaggaaggagatatgatgaagcatgtacaatggcaggatacgaccatgccgcatcaagactatctcatcatggacagattgttgctaaaacccagttcaatgcattagtgacagagataggagagtcaatagcaaatcctattgcaagaaaagctctcatcgaagggttaaaacagatatgggccatgaggaaccactgggggctgccaggatcgatacatgtagaattagcaagagacgttggaaatagtatagagaaaagaagggaaatcgaaaagcatatagagaaaaatacagcgctacgagccagagaaaggagggaagtacatgacttattagacctagaagacgttaacggagataccttactacgatatagattgtggaaagaacaaggaggaaaatgtctatatactggaaaagcaatacatataagacaaattgctgcaacagataacagcgtgcaagtagatcatatattaccttggtcaagattcggcgacgactcatttaataataaaacattatgtttagcctccgcaaaccaacaaaagaaaagatcaactccatacgaatggctaagcggacaaacgggtgatgcttggaatgctttcgttcaaagaatcgaaacaaataaagaactaaggggatttaagaaaagaaactatctacttaaaaatgccaaagaagcagaagaaaaatttagaagtcgaaatctaaatgatacacggtacgcagcgcgattatttgcagaagcagtgaaattattatatgcttttggtgaaagacaagaaaaaggcggtaataggagagttttcactagaccaggtgcactaaccgcagcattaaggcaagcatggggtgtagagagtctaaagaaacaagacggaaaacgaataaacgacgacagacatcacgcattagatgcattaacggtagcggcggtagatgaagcagaaatacaaagattaactaaatcttttcatgaatgggaacaacaaggtctcggaagaccattaagaagggtagagccaccctgggaaagttttcgagcagatgtagaagctacatatccagaggtttttgtcgctagaccagaacgaaggagagctaggggagaaggacatgcagcaacgataagacaagtaaaagagagagagtgtactccaattgtttttgaaaggaaagctgtatcatcattgaaagaagccgatttagagagaataaaagatggggaacgaaatgaagccattgtagaagcaataagatcatggatagcaacaggcagacctgcagacgcaccgccaagaagtcctagaggcgatataataacaaagatcaggctagcaacaactataaaagctgccgtacctgtcagaggaggaaccgcagggagaggagaaatggtaagggcagatgtattctctaaaccaaatagacgaggaaaagatgaatggtatcttgtaccggtatacccccatcaaataatgaatagaaaagcatggccaaaaccgccgatgcgttcaattgttgcaaataaagatgaagacgagtggactgaagtaggtcccgaacaccaatttagattttcattataccccagatcaaatatagaaatcattcgacccagtggtgaagtgatagagggatatttcgtaggactacacagaaacacaggagcacttattcccaccccagtaggacctgactcatatgtgatagcatga

SEQ ID NO: 4908 - RNA, 3024 nt, synthetic construct
  misc_feature 1..3024: note = Cas9 variant
  source 1..3024: mol_type = other RNA
atgaaagttctgggattcgacatcggaatcaacagcatagggtgggcatttgtagaaaacaacgaattaaaagactgcggagttcgactctttacaaaagctgaaaacccaaaaacaaaagaatcattagcactaccaagacgaaatgcacgaagttcaagagtccggctacgcagacgaagaagtaggctgctcagcctaaaacacataatatctaaagaattcggactacactacgaagattacattgcactcgacgggaatctaccaaaagcttacaccggaaaaatagaatcaatatacaaattaagatacgaagcgctaagccaagcaataagcaaagaagacctagcaagggttatccttcatatagcaaaacacagaggatatatgaacaaaaaccaaaaaacatcccaagattcagaaaaaggagccattctatcagccatcaaagaaaatagtaacaaaatcaagcattatcaaacagcaggggaatatttttataaagaactattcgagaacctaagggatggtactaaagagttcaaaaatataagaaacaaagcaatgaaaaatgaaaaaacgggaaacatggaatcaacatactataataccatactagcatctgatcttgaaaaagaattaaaactgattctagaaaaacaacaagcctatcacaattacagtgacacattcataaaagaagtattggaaatagcattttaccaacgccctctaaaagacttcagtcatctggtaggcagctgtacattttacgaaaatgagaagagagcatgcaaaaacagctattcagcatgggaattcatagctttaggtaagataataaacacactagaatcaattaaaaaagacacaggagaaatattcagcaatgaaataataacacaaattttaaaagaagtactagataaaggatccctcagttacacaaaattaagaaaaatgataaatctagatgagaaagtaaaatttaaaggattaaaatatgacaaagaaggagtagaaaaaacgaatctaatagagttcaaaaaattaaaagaattcaaaaaagcactaggcgaacacaacctcgaacgaaaaacattagatgaaatagcaacacatataacactcacaaaagacgaaaatcaactaaaaaaacaactggaacaatacgcactctcacagaatcaaatagatgcgttagccgaactggacttcaacgaccatatcaacttatcattcaaagcactatacgaaatactacccctaatggaaaaaggaaaaagatacgacgaagcttgcaacgaacttggactaaaagctaaaaccagcaatcaaaaatcagagttcttaccagccttctgcgattccatattcgcacaggaattaacaaacccaatcgtcaacagagctataagcgagtaccgcaaagtactaaacagactactaaaaaaatatggaaaaatgcacaaaatacacatagaattagccagagacgcaggtttaagcaaagaagcccgtaacaaaatagaaaaggaacaaaaggagaataaagacataaacgacaaagcagaaaaaacatgcaaagaattcggattaaaaccgaacgcgaaaaacatactaaaaatcaagctgtggcgagaacaaggagaaatatgcgcatactctgggaaaaaaataacaatagacgacctaaaggaagacaaggctttagaagtagatcacatatacccatactcccggtcctacgacgattcatacaataacaaagtcctagtattcataaaagaaaaccaactaaaacttaatcagacaccatacgaagctttcggaagcaatcaagaaaaatggagcaaaatacaagttttagcacaaaaactaccatataaaaaaaaaaatagaatactagatgaaaacttcaaaaacaaagaccagatagaattcatatcaagaaatttaaacgatacaaggtatgcaacaagcctaatagctaaatatactaaagaatacctagaatttctaccattatcggatgacgaagatataagtttaaaatcaggagaaaaaggaagcaaaacacacgtacagactatgaacggtatgctaacaagcgtactaagacacgcatggggtttctcccaaaaagacagaaacaatcatctgcaccacgcactagatgccataattatagcttatagtaccaactcaattataaaagcattttcagacttcaaaaaaaaccaagaaatactcaaagcaaaactatacgctaagaaattaacaagcgaagaatacaaaaaccaaagcaaattcactggatttgaaaaatacagaagcaaaattctagaaaaactagactcaatatttgtatctaaacccccgaacaaaaacactaaaggtgcactccacgagcaaaccttttacagttatcaagacatactggaagaatataaaacccaagaaggccttaaaagggcactagaatgcggtaaagtacgcaaaataggtacaaaatacgtagtcaatgataggatggtacgcctcgatatatttaaaaaagacaataaattttacggtatacccatatatactatggattttgcactaggagtccttccaaataaagtagttactatcgggaccgacaaagataaaataaaaaaggaatggaaaacaattgacgaaacctacgaattctgtttctcattatataaaggtgacttggtgcttatacaaaagaaagaaatgcaagaatcagaatttgcttattacaatggatttgacatatctagtgcaagtatcagcctcgagaaacatgataacaaatttgaaaatctaacagaaaatcaaaaattgctattcccaaaagccaaagaaggtgatgtagaagtacgaggcattggaatacaaggactaaaagtatttaaaaaatacatggtaacccctctcggggagatacaagagaccagaacagaagcacgacaaaatatacaaccacgaaaaaaacacggactgagatga

SEQ ID NO: 4909 - RNA, 3033 nt, synthetic construct
  misc_feature 1..3033: note = Cas9 variant
  source 1..3033: mol_type = other RNA
atgtctgattcttcatatgtactaggtttagaccttggaaccaacagcattggatgggcatgtgtaagattaaacaaaggaaaaccagatggactattagcgcaaggcgtaagaatctttgaagcaggattggaaatagacgcgtatggcagaggtacaccattgaacacagaaaggcgaaacgcacgacaaagaagaagattacatgaccgacgaaagaggagaatcctaaaagtgaggagaatactacaagaagcaggaatgctaccagctaataagccagatcacaaagatgctgagtggaaaatgttacttgcacgtaatccatacagattaagagccaaggctttagatgaacaaatcgacttgaaagagataggattatgcatttatcaattcgcacacagaagaggatttttatcaaatagcaaaatattaaagaaagacgatgacaggggtaaattaaaagatgctactaaagcatttgctgaagacatggaacaaaaaggagctcgaacatggggagaatacttatctcacttagacccacacgaacaacgcataagaacaaactacacccttagagaatggtatacctcagaatttgacctaatatgggaaaaacaacaatcattttacccgcatgtactaacagacgacttatataaaagggtcaaggaagcactattttatcaaagaccattgaaaagccaagcccatctattaggccaatgcgaactcgaaccaggacgcaaacgcgcaccctttgctttgttaatggctcaagaatttagattattacagagcttaaaccatcttcgagtggtatcaagcacaggcgatgaacgcttattaactgacgaagaaaggaaacaagcactggcattacttagaagcagaggaaaccaaaaattcacaacactaagaaaagtcctaaatttaagaggaacaaaatttaatttagaacgaggtggagagaaaacaatccaaggaaataacacagcagcagcattgggaaatctatttggagaagcctgggaccattttagttctgaacagaaaaatcaaatcgtagaagacaggctaacaatcggtgacacagatgcattaatacgtagaatgaagaaaacgtggggattggactccgtaactgccgaaatgttcagcgagaccgaactcgaagacggatattgtggattttcgcgcaaagccctagaaaaattattaccacttctagagagagggcacgccttaatggaagcggtacaagccgcatacccagattatcagaaaaatctgccacgaacagataccttaccaccactagaaaatttaagaaatccaatagttcaaagaaccctatctgaacttagaagagtagtcaatgcaataattaaagaatatggcaaaagtgacaaaataagaatagaattagcaagagatatgaaacaaaccgccaaaaacagggaaaaatcatgggatcggatgagagtacgcgaaagacaaagaaaagaggcagcaaagaaaatacttgaagaaacaggtaatcccgcaccaaggagacatgaaattgaaaaagtcctgctagcagaagaatgcaattgggagtgtccttatacaggaaaacgaatatgtatgaatacactacttggagacgctcctcaatttgacattgaacacattatcccattcagccgatcattcgacaatagttttagcaataaaactttatgcgacgtcaattataatagaaatgtaaaaggcaacaaaacaccatacgagagcgcatcagaaacagaacacgaagaaatggtgtgccgagtcaagagatttaccggagattataaagagataaaattagatagatttaataccagagaaacagactcaagggcagacttcatagaagaattttccacatcacaattaaatgacacaagatatgcttcaagactcgcaggagaatatttaggaaagttatatggaagtgaatggcgaaaacatatccaaattgcaaagggcggtacaacaaaatatttacgtgacgcatgggatctaaacagaatactaagcgatggaggaactaaatctagagacgatcacagacatcatgcggtagacgctgtcgtagtagcattaactacaccacaaaccgtaaaagccctaagcgacgcaaatcaaagagcaccagagcatagaaggtacgcgttctcagatatgcctttaccgtgggagacatttagacaagacgtcgaacaagcaataaattcaataacagtgagtcacaaagtatgtcgaaaagcaaatggacaattgcacaaagaaactttttatggactcatcaaagatcgaaaaaccggggacacaagaacagtactgagaaagccgttacacgaactcacagacaaagagataaaaagagccgaaatagtagatagctccatacgaaaactaatagaacaaaaattaaaagatttagaccaaccgccaaagacagcattcaaagatagaaataaccatccattcatcattgacaagaacggtaataagcgattcatacataaagtaagagtgtaccaagatgcaaaaccggtcaaaattgcggaaaacagacacgtcaaattaggaggaaatcaccatcttgaaatatttgaagtaatagataagaagggaaatccaacatggaaatgtgaagtaatatccttatttgacactagacaacgagtcaaagaaaagagacccgtcatcgttagacaagatcaaaatggaaatccattaaaattctcattatccatcggagaagcagtacaattagactggaacggaggaagagaaacagcagttgtacaaaagatgagtaaaacaccgaatactgtcgaatatgtatttagaaaacacaatgatgctcgcaaagcggcagacataccatataaagaaacaatcacagtaaaaagcgatagcgccctctttgcatcaaacttacagaaaattgtaataactcccacaggccttatacgacgagcaaacgattga

SEQ ID NO: 4910 - RNA, 3033 nt, synthetic construct
  misc_feature 1..3033: note = Cas9 variant
  source 1..3033: mol_type = other RNA
atgaaaaatagaaatgtaataggcattgatgttggcactaactcgattggatgggccctagttgaagagaacgaaaatggtttaccacaatctctaaaagcagcaggcgtaagaatattccaagaagcagtagaagcaaaaaccagaactcccaaaaatcacaaaaggagacaagcaagactagctagacgagttctggcgcgcagagcaagaagaaaacaaagacttcaaaatctactattaaaacatggactgctcccaggaggagtaacagaccctgtccaaagagaagccgctttcaccacactaggagatccttatcagttacgcgcaaaaggactaaatctcccgttgggtctacatgaatttggacgcgtcctatttcaactaggcgcaaggagaggatttttaagcaacaggaaaactagatatggacaccttaataaactagacgagttagctgatttaattgaagcagaggacgcagcacccaaaactggagatgcagaagaaggaataattcgaaaagaaataggagaattaagacaagcgatgtcagcagccggtagcagaaccctgggcgaatatttagccggcttagcgaaagaagaaaggaaaagatgtcgacatacagaacgtgcaatgttagaggaagagttcgaacgtctttggatggtacaagcgagatttcatcctgaattgagtgacgaactaaaagtacaagtacacactgtgatattctttcaaagaccccttaaatcaaatcgagccagtttgggaaagtgtagcctagaaccatcaagaagaaaagcagcaagagcatggccagaagcccaacgatttaggttactccaagacttaaataacctcgaaatattggatccaagaacgggggaattaagaagattaagagacacagaaagagctattttgttgaatgctctagaacaacaaaaatcaatgacatggaacgctgtaagaaagaaattaggccttcatcaaggtgaaaaatttaatttagaaaccggggcaaaagctgaaaccggtctaaaaggactacagaccctagcatcattacatgcaatcttacaggggtggttcgacgaactaggagataaaagagatctgctaatagaagacctaataacaatagaagatagtgcaggactatacagaagattacgagagcattggggtttcgatagagaaacagcgttcagattagcgacattagaactagaaccgggatacgcatccctatcactgaaagcaatcagaaaattattaccgcatatgggagctggccatagatactcggaagcccgacaacaagtgggttacggatatgaaacaggacaaagagatttacaagaaagattaggagaaccaccagatcctagaaatccagtagtagataaagccctgcacgaactacgccgagtaataaatgcattaatacatagatttggaagacccgatgtagtaagggtagagctggcaagagatctgaaattagcaaaacgagacaaagaaagactcgaaaaacaaaatagagaaaaccagagactgaacagaaaagcagaagcagcactagcagaattaggtttaggacagccctcacgagacgacctaattaaatatagactttgggaggaatcgaaaggcctatgtccctataccggaagagaaataggcctaagtaccttattcagtccggaagtagatgtcgaacacattataccctacagtagatgcctagatgactcatacatgaataaaacattatgcatgacagaagaaaaccgaatgcagaaaggaaaccgcacaccatgggaggcatacggcggcgacccagcaagatatgaacaaatattacaatgcgcgagatattttcctatggccaaaagaaaaagattcttagaacagggctcagattttgttgaccaattcatacaaagacaattaaatgacacgagatacatagccaaattagcgaaagaatatctagcagctgtctgtaccaatgtccaagtaacaaaaggaggaacaacagccatgctaaggcatcactggggattaaataggctattaggagaggatgatggtcaaaaagagcgaggagatcacagacatcatgcactagacgcagcagtcattgcagtcacttcacgaagtctctatcaaagactcgctcgcatcgcacaccaaagaggtcatgcgccaagtcaaagggggttttatatagacccaccttggcaaggatatcaagcggatctagctcaaacattggccggaatcgttgtatcccacgctactaatagaaaattaactggagcactacacgaagaaacagcctacggtcacataccgcatgtaggttttgtttatagaaaaacactcaacaaagatttcaaactcggggacatagaagctatatacgacccatcattacaagaattagtcaaagcgcatttagaacatcacggaaatgaccctaaaagagcctttgccgaaggaatccaatgctatcataaagacggtcacacacctattaaacgagtaaggattcgagcaaagcaagtatcagaaaaaggaacatttagtattagcgatagggctggcagagcctataaacatcataagacaggaagcaaccatcatgtcgaaattttaagacacagagcgactggaaaaatagaaccagtatatctcactacaaaagaagctacagaaagagcacgcagagggggcgaacccgtcatacaacgtgatcatggcccagaatgggaatttataataagtctctgcatcaatgatatggtacgactaggagaaggaggacaagtcgcgtactttcgcgtacagaaaattgaagcaacgaataatagggtcacccttagaagtcatttagccgctactctagacgacgaagatatgaaagttacaacatcagttcctaagctagcagtaatgcccggcttccaaaaagtattagttacagcagttggagaagttttagaacttcacgattga

SEQ ID NO: 4911 - RNA, 3033 nt, synthetic construct
  misc_feature 1..3033: note = Cas9 variant
  source 1..3033: mol_type = other RNA
atgaagagaatggcagcagtcggacttatgccagcagatcctacagaagcaaaagcactcgaattactagatccatatgcactaagggcggcaggcttagatcaggccctgcctctaacccacttcgggagagcattatttcacttaaatcaaagacgaggattcaaaagtaatagaaaaacggacaaaggagataacgaaagtgggaaaataaaagatgcaaccaaaagactagatgaagaaatggctattaagaacgcaagaacatatggtgaatttttacatatgagaagaacatcagcaaccgatccgaaaaatgtaccaacagtcagaacaaggttgtcgatagcacgaagagataacgccgaaaaagaagaagccggttatgatttttacccagaccgaagacatttggcagaagaatttgataagttatggaaagcgcaagcaggatactcaccagacgtactaacagacgaattaagagatgaaataagtgtaataatatttcatcaaagaccattaaaaacgcccgaagtcggactatgtctattttccggctcacacggcgtacctaagaaagataaacggatacctagtgcacatccattaaatcaaagacgaatactatttgaaacaattaacaatttacgcgtagcagcaagaggagaaccagccagaggtcttacaagagatgagagggatgcaatagtacacgcattagataataaagcgcatacaaaatcactatcaggaatgtccatgaaactaaaggcattaggaaaagtaataaaattaagaccagaacaaagtttcactctacaaacggcgaatagagaaacaattgcatgtgatccagtaagagcaagcctaagtcatccagatcgatttggccctagatggagtatgctggatgctgacgcacagtgggatgtagtacaaaggataagagcagttcaatcagaagccgaacacgatgctttagtaaaatggctaatggcaacacacgggttagatagagaccatgcagaaagtactgcaaaagcacccttaccagaaggatatggaagactaggattaactgctacaaaaagaatactcgctgcactagaagcagatgtaataccatattcagatgcagtaaaggcatgcggatggcatcactccgatggacgaacaggtgaagtacttacagaattaccatattatggtcaaatattggataggcatgtgataccaggaacatacaacgaatctgatgatgacgttacgagatacggtaggataacaaatccgactgtccatattggtttaaaccaattaagaaggctagtgaataaaataataacagtatatggtaagccagatgagattgtagtagagcttgcaagagacctaaaattaagtgaagatcagaaaagggatgtacaaagagatataaagaaaaatacagacgcagccatagcgagaggtgcgaaattgtcagagatgggtgtacccgatactggagcaaataggatggtactgagattgtgggaaagtttgggtgatgacgtaatgacacgcaattgcccttattcaggcaaaagaatttcagccacaatgttatttgatggcagctgcgatgttgatcacattttaccttactcaagaacacttgacgacggatttgctaacagaacactttgtctaaaagaatttaatagacaaaagacagataagacaccatgggaagcatggggagatactccagcatgggcgacaatagaagctaacctcaaaaatctaccggcaaataaggcttggagatttgcaccagatgctatggaacgatttgaaggagaaaatgacttcaccagtcgtgcactaaaagatgcacaatacctttctaggatagcccgaacgtatctggacgcactatatgatggagcagatggaaaaagtcatgtatgggttgtacccggaagactgactgaaatgttaagacgtcactggggattaaattcgttattaccagataaagacggtgcagtaaaagcgaaaaatagaacagatcatcggcaccatgcaattgacgcagcagtagtcgcagcaacagatagatctttaatccaaagaataagtaaaatggcgagaaaagatgaagtgaacggagcagaagaagtagctagatcggttcctccaccgtgggaaggattccgcacagatatagaaactcaattggaccggataattataagtcatagagcagaccacggaagaatagaccccgcagcaagaaaagacggacatgattctacatcaggtcaattacataatgacaccgcctacgggcttggagaaggtaacagcgtggtttccagaaaaccattattgagcttaaaatctaatgatatagaagtgacaacaaaaggcgcgaatataagggatgtagacttacaacgtcatttagagagaataacaagaggattagacggaaaagccctggaagcggcattagcagagttcgctgcaactgcgaaactaccagacggaactgataatccatattacggcttaagaagagtacgtctagaagaaacgctccaacaaggagcaagagtggaagtaaaagatagaaacggaaaaccattcaaagcctataaaggtgattcaaaccattgttatgaaatatggaggatgccagatggaaaagtagtacctcaagttataacaacatatgaagcacatcagatcgatgttgaaaagaaaccacatccggccgcaaaaagattgttacgtatatttaaaagagatatggtcgcgattgaacaagatgacaaagcaattattgggtacgtccaatcgatgcatgtcgccaatggcctatttattgccccgcatacagaagctaatgccgatgcaagaagtagagataaatcggatagttttaggttaatccaaatgtcagcaggaccgctagtaaaagcaaatgcaagaagagtttatgtagatgaaatgggaagactaagagatccaggcgccccatcatga

SEQ ID NO: 4912 - RNA, 3039 nt, synthetic construct
  misc_feature 1..3039: note = Cas9 variant
  source 1..3039: mol_type = other RNA
atggcaaatatgcgttacagattggcgcttgacctaggaagcacatcattaggatgggccatggtaagattagacgcccaaaacgaaacctgtgcagtaataaaagcgggagtaagaattttcagcgatggacgaaacccgaaagacggaagtagtttagcagtatcacgtagagaagcaagagcaatgaggaggaggagagatagactgcttaaacgtaaaacaagaatgatggcaacactaatgaagcacggcttcttcccacaagatgaagccgctagacaagcattagtaaataaggaaccattcgccctaagagcaaaaggactagaccatgcactactacctgaagaatttgcaagagcactatttcacataaatcaaagacgaggttttaaatctaaccgtaaaacagataagaaagaaaccgacagtagtgctctaaagaaagcaataggacaactaagggaagctatgcaagcatcaggatgtagaacagtcggtgaatggttatgtgctagacatcaacaaggcttatcagttcgtgccagatatcgagaaaatagaataactaaagatgatggtaaaacaaaaatagagaaatcatacgacttatatattgatcgagcgatgatagaggctgaatttgatgccctgtgggcaaaacaatcagagttaaatccagagttattccacgaaactgctcgtgcagagttaaaagattgtctattacatcaacgaccgctaaaaccagttaaacctggaagatgtactttgctaccagatgaggaaagagcgccacttgcgctaccgagccaacaaagattcagaatataccaagaggtaaacaatcttaggctactacgagaaggattaaatgaagaaccattgacattaacacaacgcgatcaattgatacaggctttagaaacaaatccaaaacgatcatttacacaaatacaaaaattattaggatttagtggacaattcaatctacaagacgataaacgtacagaattaaaaggcaatagcacaagtgctatgcttagcaagaaagaatttttcggatcacaatggctatcatttgatgaaactcatcaagatgaaatagtaatgcaattagtaagcgaagaaaacgaagcacggttaatagcttggctacaagcagagacaggagtcgacgaaatcactgcagagagaatagcaaataccccattagcagaaggatatggaagtttatcagcaaaagcattagagaaaatcctcccagccttacgagcagatgtaataacctatgataaagctgtattagcagctggatttgatcatcacagtcatatatcacatgcagcaacaggtgagatcttaccagatttaccatattacggacaatatctacaaagacacgtaggatttggtacaggcaaacctgaggaccctgcagagaaaagatatggtaaaatagcaaacccaaccgtacatataggattaaaccaagtaaggaccgttgtaaatgcacttataaaaagatacggacatcctagcgaagtggtagtggaattagcacgcgatctaaaacaaagtcaagaacaaagaaaagaagaacaagcacaacaagctaaaaatcaaagaagaaatgagaggatgagacaagatatagcaggcctattaaacacaagtaccgagagagtaagggcattagatttacagaaaatgattctttgggaagaactatcgtttaatgtcgcagacagaagatgtccttatagtggtgtgcaaataagtgcacaaatgctctttagtgatcaagtcgagatagaacatatcctaccttttagccaaacactagatgattcattaaataataaaactgtagcaatgagacaagcgaaccgaataaagggtaatcgaaccccagcagaagcagcagccgattttgcagcacaaggctggcctgtcgaagatatgttacatcgtgcttctttaatgccaaaagggaaacgatacaggtttgctcaagatgggatggcacaatggttaagagaagataaaggctttttagcaagagcacttaatgatacacgtcatctaagcagagtagcacgagaatatttaagtttagtctgcccacaaggaacccgagtaattcccggtagaatgactgccatgctaagagctaaattcggtcttaatgatatacttggccttaacggtgaaaagaatagaaatgaccacagacatcatgcagtagatgcctgtgtaattgcggttacggatcagtcgatgttacaaaaattcgcaaaagcatcagcctcagcaagggaaaagcaactaaataaattagtcgaatcaatgccattaccttgggactcgtatagggaccacgtacaaagagcagtggagcgaatatgggtatctcataaaccagatcatggacatgaaggagcaatgcataacgatactgcatatggactcttaggtggaggccacgttcaagttagaaaaaggatggatggtgtgagaacacgagaaacagctgcattaaaagttatagagttcgctgaccgacaagcacatccacgacatggattattgccaaacggagaaccaatgccatacaaaggatataaaggcgattcaaattactgtatggaaattgttcgaaatgataaaggaaaatgggaaggagaagtagtcagtacctttgaagcgtatcaactggtaagacaacatggtttagcaagactccgacatccggcgttaagtgtatcagggaggccacttgttatgcgactattgaggaacgacacattaagagtaatacacaacggtgaacaacgaacagtaagaatatgcaaaatgacggcggaaggagtaatcgcattagcagataccacagaatcgaacgtggatgcaagaacgagaaccaaagatttatcatatatatttaaaaccgctggatcacttcagaaaagtaaaggtagacgggttgcaataagcccttcaggagaaatgaaagatcctggattcttcgactga

SEQ ID NO: 4913 - RNA, 3051 nt, synthetic construct
  misc_feature 1..3051: note = Cas9 variant
  source 1..3051: mol_type = other RNA
atggaagtctttgtagatgtaagcgcaaggcaattaggcatagatttaggtataggaacatgtggctgggctctcctggctgaagattcattaatagccttaggtacaagaacatttgatgttccagaaacagataaagaaaggatcccgaccaaccagatccgacgtcaagcacgtggcatgagacgagtaatagatcgaagacgacaaagaatgaacgctgtcagaagactgttggcagatcatggtctgctcgcagatgggggaaaattaggcctcgcaacagttagactcgatccatggcaagcaagagccgaaggtctagatcgtttacttagtgctggtgaattagcagttgcactaggacatatagcaaaacatcgcggattcagaagtaatagcaaaagggaccgaggcgctaatgctcctaaagaatcgtctgccatgctgggagcaattgcacaaacgggagaacgactccaacattggcgaacggtaggagaaatgttttggaaagacgaattttaccaaacaagacgaagaaatagagatggagattatagtagaactgtacaaagattagatttagaaacagaagttcacaggttattagctgcgcaacgacgcctgggaaacccattagcaacatttgatttagagcaaagttttatagacgtagcattctttcaaaggcctctagcggacagcgatgataaggtcgggccttgcccatttgaaccttcagagaaaagggctgcaagacattcgccgtcgtttgaacgatttagactgttaagtcgattagctgcactaagactatcaagtggtgctggagaaaggccattaagcgacgccgagttcgcagctgcctgtgcagacttcggaaggctacaaggattttcattcaaaagattaaggcagcatttaaaactagatccgtctatcagatttgcaggaatagcacccgatgaagaaggaaaaagagatgtagtagctaggtcgggagaagccaccccgggaagtgcagcattaagacattgtttgggggacacagtttgggataatatgcttggaacacgacccgcattattagatgcaatagcagccatactcacatttcgagatgatgcagatagaatagcggaaggattagcaggtttaggaatagaagaaccgattttagatgcattaatggatggggttagaaacgggtcatttggaaaatttaaggggccaggacatatatcagctaaggcatgcagagcattactcccccatttagcacgagggagagtatattcagacgcatgcgctgatgcgggctatgatcacagtaggcaaactgaaacaaatttagacgatataagaaacccagtagcaaggaaagccttaggtgaagcattaaaacagataaagattataatccatacacacggaaggccaacagcgatacacgtagaaatggcaagggatataggtaaatcagcagatgaaagagacgaaataaagaaaggaatagataaaagaaactcagaaaaagatagagccaggcagcaattccacgaaatggttggaactccagcagccggtgcagaagatttgttacgctttgaactctggaaagagcaaaatggatggtgtttatacacaggaagagagataccaattgatgcactggtgtcatcagacaatcgaatacaggtagatcatatattaccatggagcagaagtggagatgattcatatattaataaaacactatgcttcactgaagcaaaccaacacaagaaaggtatgacaccatgggaatggttacacgatgacccagaacgttgggaaaaattcgccagaactgttgaaggctgtaaaactatgaaaggaaggaagaaaagaaatttgttattaagagactcgtctagattagaaaaagagttcagatcccgaaatttgaatgatacacgttatgcatgtagattattattaggaatattaaaacatacatatcctgatatagtggtcgccgccaggcctggccccttaacagacagattacgacgagcttggggactacaatcactaaagaaacatgaagatggaacccgaaaagatgatgataggcaccatgctctagacgctgcagtagtggcagcaacatcacaaagtatgttacaacgattaacaacactatttcaaaaagctgaaagagaaggtggaagaagggacttcgtaggactggaacctccatggccaggtttcagggcagatttagaagcaaaattagaaggggtggtagtatcgcgggcggaacgaagacgagcaagaggtgcaggacataaagacacgataagagccataggagaaggtgacgctggcccagtagtgtacgagagaaaacccgtagcagctttaacagaaaaagatttagatagagtaaaggacccggaaagaaataaagtgttgatcgaaaatttaagacaatggatagcagcgggaaaacctaaagatcccgacaaggccccacgaagcccaaaaggcgatccaatgactaaggtaaaattagtaacaacagatgacgtacgaatcttagtaagaggcggaacagctgatagaggggacatggcccgagttgatgtatttagacaggcggatccaaaaggaagatggaggtttttcttggtaccagtatatccacatcaagtatttgaccctactgattggcctcaacctcctaatagagccgtggtagcatataaaccagagaaagaatggacggttatgggaccggaccatgagttcttatggtccttatacccattttcatggattgcggtagaaaaagcagatggaacaagaatcgaaggatactttagaggtatgcatcgttctacgggagcaatctccatatcgccccaccatagcaagagcttagcatcaaccggaataggagcaaaaaccctagcaagttttaggaaatttgcaatggacagaatgggtaacttatcagaaatagaaagagaagtacgaacttggcatggggtagcatgtacgtga

SEQ ID NO: 4914 - RNA, 3054 nt, synthetic construct
  misc_feature 1..3054: note = Cas9 variant
  source 1..3054: mol_type = other RNA
atgagagtagattcattaggaaggtgtttatcagatgaagaatgggctagagttatataccatttatgtaaacatagaggatttcattggatatcaagagccgaagctaaacaaacagaaggagacagtaaatcagaaggagggaaagttaaacaaggcttagcaggaacagcaaaactaatggacgaaaaaggttatcgtagcgcagcagaaatggtattagccgagttcccagaagcacagaggaataaacaaggagaatatagaaaagctctatcaagagaactactagcaaaagaattagcactcttattcgccagacaacgagtttttggaaacagacatgcaacggacacattagaaacagctatactaggtaattcagataagaaaagcggcctattttggcaacaaaaaccagctctagcgggtgcagatttattaaaaatgctaggaacatgtacttttgagaaaaatgaatatcgtgcaccaaaagcgagctttacggcagaaaggcatgtgtggcttacaaggcttaataatctacgaatagtaacggacggaataacacgacaattaacagaacaggaacgacaattagtactaccacttccctatcgacaagcaggggatttaacttataaacaactaggaatggcattaacaaaagcaggattacttgaagcaggatgttttaaatttataggtttagcgtacccaaccgaagcgcaaaaagcggaaggtaaaactaaagatccagaaagcgcgaccctcgtaaaaataccggcatggcaagaattaagacaaacattaaacaaagccagtctaaatgacgaatgggaaaaactttcaggagatgccctttgcggtcagccagaaatatttgataaaatagcttggatactttcagtatacaaagatgatgacgaagtacgaacagaattagccaaattagtactgcccaacccagaaggactaaccgaagcactacttaatataaggtttgataaattccatgcattatcactcaaggctttaagggcaatagtcccacacatggaaaaaggtttaagatatgatgaggcttgtgttcaagcgggttatcaccattcacaattacacaaaataggagaaggcgaacataaatacctacctcctttatacgatggtagagacggagatggtagaatgatttttgcggaagatgccgatataccacgaaatccagtagtattgcgaagtttgaatcaagccagaaaggtagtaaacgcgattattagacgttacggatccccttcagccgtacatatagaaatggcaagagatctcagtagaccatttgacgaacgtaacaaaatcaagaaagatcaggatgaatatcaagcaagaaatcaaagagatagggaacaatttatagaattgtttggacatccacctaaaggactagagttcgaaaaatggcgactatatagagaacaaaatggacaatgtgcatactcacaaaaacccttagcaagcagtggagatgtcgctgaaatttttcttgacggctctacagaaatagaccatgcattaccatattctagatcttttgatgacagtaaaaataataaagtattagtacttacacgagaaaatagagataaaggaaaccgaacaccgtatgaataccttggaggagcagaaaactcagagcgttggcaaagattctttagttttgtagaatccaataaagcataccgacttgcaaaacgaacgcgtctgctgagaaaagattttggagcaaaagaatcagaagagttcagagaacgaaatttaaacgacacacgatatgtctgtcgcttctttaaaaactatgtagaacaacatctgaaacttgctgaaggatcagaagccaaaaggtgtgtagtcgtatcaggacaactgacaaactttctacgaaccaggtggggtttattaaaaatacgaagcgattctgatcgacatcatgcattagacgccgcagtagtagcagcctgctcacactccatggtacaaaggctaagcaactatagtagaacacgagaactggagcaggtacgagatggttttgtcaatatcgaaactggtgaaatagttaatcctgctatgcaccaacaactccgtgaacattttcctgatccatggccgtattttagacatgaattagaagctcgactaaaaatagatagtccagctttattacgcgaagaaatggcaagactgtctagctacacagaagaagaactagcagcactaaaaccactgtttgtaagtagggcacctcaaagaagaaatggtggtgctgcacataaagacacaatttatggacaaccagaaaaactaaagaaaaacggttctgtatcacaaaaagttgcactagcctcgcttgcgttgaaagacatcgatttattggccgatccccatcgaaatgcgaaattatatggagcaataagggaaagactagaagcccatggaggaaaaggggataaagcatttcccgccacaaatccactcaggaaaccagacaaagaaggcaatccaacaggtccaattgttagaacagtaactaaagtcatcgataaactaagcggaatcccagtccgaggaggaattgccaaaaatgacacaatgttacgagtagacgtgtttacaaaagcaggcagattccatttagtgcctgtttatgttcatcatcgagtcaccggattacccaaccaagcaatcaccagaggtaaagatgaaaatcaatgggcgataattgatgatacattcgaatggcgattttcattatatcctaatgatttagtacaaataagactcaaagatgaaacacatctcggctactatgcatcaactgatagaagtacaagttcaatatcaatttgggctcatgacagaaaccagtcagtaggaaaagatggtttaattcgaagcataggagtaacaacagcgaaagacattgagaaatttcatgtggatacgttaggaaacgtataccctgctcccccagagaaaaggagaggactcgcatga

SEQ ID NO: 4915 - RNA, 3066 nt, synthetic construct
  misc_feature 1..3066: note = Cas9 variant
  source 1..3066: mol_type = other RNA
atgagaagaagaagagataggtttaaacagagacaggcagcgttattaaaacatttggcaggagtaggattatttccagcagacgaagctgcacgcagagaattagctggtttggatccgtatgagctaagagcgagagcacttcatgaagcactaccactgaaccatatcgggagggctctattccacctaaaccaaagacggggttttaaatcaaacagaaaaactgacagaggtaaagctgatgatgaaggtaagatcagactaggcgttgcacgattgcaagaggcaatgcatgaaaaaggcagtgcgacattaggagagttcttgcatggaagacgagcagcagcaacagatcccaatcaaattcctagcgttagaacaagattaagagcagaaagtggcgaaggcgcaagaggagatggttatgatttttacccagatagaaggatgttagaggacgaatttgaagcaatatgggaatcacaacaagtgcatcacccagcagttcttactgatgaaataaaacaaagattctttgaagtaatattttaccaaagaccgctaaaacaaccagaaatagggacatgtacactcgtagctggcgaaagaagattaccaaaagctcatccactatttcaaaagagacgattattagaggaactaaatgctttaagaatcgtttggccaggagtacaagccgaattgttatcacgtgaacagagggacctagcatacctgaaattaaaagataaaagggcagttagatttgaatcactaagaaaagcactaaaattggatcctgatgcaagatttaataaagaaagtgaaaaccgaagtgaactaaagggtgatgaagtggcagcagaactaggagccaaatcgcgttttggaggaagatggggacacacggcaccagcggaccagtgggaaatagtttccagaatacaagccttggaaagtgatgatgacgaagcacaattctgtgtttggctatctgaaagatatggtctagatagcgagcaagcaagggcagtagcagcagcacgattaccacaaggtttcgggcgttttgggcttactgcaactacccgcttaattaaggctttacaagacgaagtcattgtatactcagaagcagtacaaaagactggacttgggcaccatagtgactttcgcaacggagaagtattggcagaactcccctattatggaatcgcgctagaaagacatataatgccaggtacaggagatcctggagatagcgatgaaatgagagtgggtcgagtaacaaatcccacggttcatataggattaaatcaattaagaagagtagtaaaccgattaataaaaagatacgggcctcccagacagatagcagttgaattagcacgtgaattaaaactagatgatcaacataaaagggagataaatggaaggaatagacaaaatagggaagcagcggaacgaagaagtcagaaattagtagatataggtattgcagacaaaggagcaaacagggcattattgaaattatgggaagaactaaatccagataatgccttggataggagatgcgtgtacacggggagacaaatttctatagaaatgttatttagtggggcagttgaagttgatcacatattaccgtttgcagcaacgctagacgacagcaatgcaaataaattattatgcttgagggaagcaaaccggaacaaaagaaggagaagtccattcgaagcatttggtcagggagcagattgggaagaaatagcagcacgtgctgctaggttaccgagggaaaaacgatggcgttttgaaccagatgcaatggcaagatttgatacagaagagaaatttttagcacgacaattagtcgacactcagtatttaagtcgcctggcaagagaatatttaggcgtattatttcccgacaaaggagaggggtctggacgagtatgggttagtccaggaagacttaccgagatgctaagaagatcatggggattaaatcatttactgccggatcacaatctaggaggaggagcagatcaacctaaaaatagaagggatcatcgacaccacgccattgatgcaatagttgttgcagtaaccgatagacatttactacaagctatagcgagagaagcaggacaaagaggacatgaggcagccaataggatgacagctgatctaccagttccttggccagactttgatagagatgttgggcaagtcataagacaggtcgtcgtaagtcatcgcgctgaccatggtacagtttcaaaggcaggagccgcgaaaggacaagactcaacggctggcagactacataatgacactgcatacggcctaacaggacaaaccgatgaaaaaggcaatacgatagtggtaaggagagtcccgttaactgcattaaagaaacctacaagtatcgaggctgtacgagatgatgaattacgaaaagcattaagtgtctggactagaggatatgatggaaaagcctttgaagcaagattaagcagatttccggaactaggaccattacagtttagaggaataagaagagttagagtcgtcgagcctcttaccgtaattccaatccgagatagcagtggtcgggtatacaaaggatataaaggtgactcaaattacaggtatgatgtatgggaacttaaagatggtaaatgggtagcagaagtagtgtcaatgttcgatgctcatcaaagttcttggacaagtccggtaagaagagaaaatcctactgcgcgaaaggtattaagtctacaacaaaatgatattgtggctattgaacctgaaggaaaagaaagagaattaatgcgagtggcacaacttagacaaggtggtcagataaccttagcagcgtgtcacgaagcaggggatttaaagcgaagagatgcggaaagtaatgaagtcgatccttttaaatattttagtccaacagcagggggtctaaagagagtcagagctagacaagtaagagtcgacgaattaggacgagtactagatcctggaagtagagacagagagcgtggggcagcgtga

SEQ ID NO: 4916 - RNA, 3066 nt, synthetic construct
  misc_feature 1..3066: note = Cas9 variant
  source 1..3066: mol_type = other RNA
atgaaatataccctgggactagatgtcggaatagcatcagtaggatgggcagtcatagataaagacaacaacaaaataatagatctaggagtccgatgttttgacaaagcagaagagtctaaaacaggagaatcactagctaccgctagacggatcgccagaggaatgagaaggagaatcagtcgacgatcacaaagactacgcttagtcaaaaaactatttgttcaatacgaaattatcaaagactcaagtgaatttaacagaatatttgacactagccgagatggatggaaagacccatgggaactaagatacaacgcgctatcacgaatattaaaaccctacgaattagtacaagttctgacacatattacaaaaagacgaggattcaaaagcaaccgcaaagaagaccttagcactacaaaagagggggtagtgataacgtcaataaaaaacaactctgaaatgctcagaacaaagaattacagaactataggagaaatgatattcatggagacccccgaaaacagtaataaaagaaataaggtcgacgaatatatacataccatagcgagagaagatctcttaaacgagatcaaatacatattcagtatccaacgaaaactaggttcaccgttcgtaaccgaaaaacttgaacatgatttcttaaatatatgggaattccagagaccattcgcatcaggagatagcatcctatccaaagtaggaaaatgtaccttattaaaagaagaacttagagcacccacctcatgctatacctcagaatacttcggtctgttacaatcgattaataatctcgttctagtagaagataataatacactgacattaaacaacgaccagagagctaaaattatcgaatatgcacattttaagaatgaaataaaatacagtgaaataaggaaactcttagacatagaaccagaaatactatttaaagcacacaacttaacccacaaaaatccatctgggaataacgaatcaaaaaaattctacgaaatgaaatcataccacaaacttaaatccacattacccactgacatctggggaaaactccactccaacaaagaaagccttgacaacttattctattgtctcacggtctacaaaaatgataatgaaataaaagattatctccaagcaaataaccttgactatctcatagaatatattgccaaactacctacattcaacaaattcaagcatttatcattagtagccatgaaaaggataataccattcatggaaaaaggatataaatatagcgacgcttgtaacatggccgaactagattttacaggatcttcaaaactagaaaaatgcaacaaactaactgtagaaccaatcatagaaaacgtaacgaatccagtagtaatccgtgcactgacacaagcaagaaaagtcataaatgcaataatacaaaaatatggactaccttacatggtcaatatagaactagcaagagaagccggaatgacgcgccaagatcgcgacaatttaaaaaaagagcacgaaaacaaccgaaaagcacgagagaaaatatcagatctaataagacagaatggacgcgtagcatcaggactagacatcctaaaatggagattatgggaagaccaaggaggaagatgcgcttatagcggaaaacccataccagtttgtgacttacttaacgactcattaactcaaatagaccatatatacccttactcaagatcaatggacgacagctacatgaataaagtattggttctaaccgacgaaaaccaaaacaaacgaagctacaccccatatgaagtctggggatctactgaaaaatgggaagacttcgaggccagaatatactcaatgcatctcccgcaaagcaaggaaaaaagattactaaacagaaatttcatcactaaagacctggattcatttatatcacgaaacctaaatgatacacgctacatatcaagattcttaaaaaactacatcgaatcatacttacaattcagcaatgattcacctaaaagctgcgtcgtatgcgttaacggccaatgtaccgctcaattaagatccagatggggactaaataaaaaccgggaagagagtgacttacatcacgctttagatgcagcagtaatagcgtgcgcggacagaaaaataatcaaagaaataacaaattattataacgaaagggaaaaccataattataaagtaaaatatcctctgccatggcactccttcagacaagacttaatggaaactctagccggagtatttatatcaagagcaccaagaagaaaaataacgggaccggcacacgacgagacaataagatcacccaaacacttcaacaaaggacttacctcagtaaaaatacctttaaccactgtaaccttagaaaaacttgaaacaatggtaaaaaacacaaaaggcggcatctccgacaaagccgtatacaatgtattaaaaaaccgactaatagaacataacaacaaacccctaaaagccttcgccgagaaaatctacaaaccacttaaaaacggaacaaatggagccatcataaggtcgatacgagtagaaaccccatcctacacaggagtgttcaggaatgaaggtaaaggcatatcagataattcactcatggtaagagtggatgtttttaaaaaaaaagataaatattatttagtaccaatatacgtagcacacatgataaaaaaagaattgccatccaaagcaatagtacccttaaaacccgaatcacaatgggaactaatcgacagtacacacgaattcttattttccctttaccaaaatgactatttagtaatcaaaactaaaaagggaataacagaaggatactaccgatcatgccatagaggaacaggcagcttatcactcatgccccatttcgcaaacaataaaaacgtgaaaattgacataggcgttcgtacagcaatttcaatagaaaaatataatgtagatatacttggaaacaaatctattgtaaaaggagaacctcgtagaggcatggaaaaatacaacagttttaaatccaactga

SEQ ID NO: 4917 - RNA, 3072 nt, synthetic construct
  misc_feature 1..3072: note = Cas9 variant
  source 1..3072: mol_type = other RNA
atgaaaatccttggatttgatataggagtagcaagcattggatgggcatttgttgaaggcgatgaaatcagagattgcggagtaagaatattcacgaaagctgaaaatccaaaaacaggtgaaagtctagctctgcccagaagagaagcacgcggagtaagacgacggctcgctaggaggagagtaaggcttaacactattaagaaaataatatgcaaagaatttgacctaagattatccgactatatagcagacgacggcgaactacctaaggcttatcaaaccaacaaagatacaaaatcaccatacgaactaagatataaagcactaaacgaacgactttcaaaagaagaattagcaagagtaatactccacatagccaaacatcgaggttacggcaacaaacacgctaaagacggggatgataaagatagcggtaaagtaaagaaagcaataggagaaaataaaacactactagaacaaaaagggtacgaatcagtaggcgaatattgcttcagagagttcttcaaatcaatcaaagacaaagatggggaaacacacaatataccaagccagaacatacgaaacaagaaaggtaactacgatagatgtgtttcgcaaaaacaattagaggatgaactaaaattaattttcgcaaaacaacgaaaactcgggtttaataaagagttcgaagatgcgatattagaagtagctttttaccaaagaccgttaaaagattttgatgacaaaataggagactgtattttctttgacaatgaaaaacgagcaccaaaagaatccatatctgcaatagaatttgtagcgttaactagaataataaacacactaaaatacctatcaaaaacaacaggagaagtatatgaaaaagaaatcattaacaaaatctggcaaaagatactagaaaacgggaaaatgacttacgcggaattaagaaaaatattagcactagattcaagcgtgtttttcaaggataaagacctcgactacaccttaggtattaaagaagcggagaaaataaaattcatagagttcaagaaactaataaaattcaagaaagcactagggtcattcgatggattatccagggaaatactcgacaacatcgcaatgcaaatagcaataacaaaagacaggcaaagattattagaaaaacttgaagtgtttccactaaataaagaacagaaagaaaatttaagtcaactaaattttagtaaatacatagatctaagcctaaaagccctaaatcagatacttccatttatgagagaaggtcgaagatacgatgaagcaaaagatgatgcgaaattgcaagaaaaagcgaaaaatactaagaaagaagagttcctaccaccgttaaaagaatttgatctaaacttaacaaatccagtagtagcacgcgcactcgcagaatttagaaaagtactaaacgccctacttaagaaatatggcaaagttcataaaatacatttagagttcgcaagagacatgagactagatttcgacgaacgagaaaggctcatcagtatacaaaacgacaacttcaataaaagacaacttgccgaagatttttgtaaagaacatggtctagaaccatcgaacgcaaatattctaaaaataaaattgtggcaagaacaacaatggcactgcatgtactcaggcgaactcatagggataccagacttaaaagaccctacaaaactacaagttgatcacatatatccatactcgagatcttttgatgatagttatactaacaaagtacttgtcagagcggaatggaaccaagaaaaaggcaatcatacccctttcgaagcattcggcggcgataaaaacaaatgggataaaattgtagcactagctgaaaaactaccaccatcaaagaaactaaatagatcagaaaaatcaaagaaagataaactactagacgaaaaatttaacgacaaagaactcggatttttagcacgaaatatagtagacacaggttacatagcaagacttgtagcgaaatatatcgatatgtaccttgagttcttaccacttgaagaaaatgaaaatacctctttagcccgaggagaaaaaggcagtaagaaacatataggaatagtaaacggaagacttacatcagaagtaagacataactggggccttgatcctaaagatcgcgataatcacctacaccatgctattgatgccatagtaattgcatacatgaacgataaacgaataaaagcatttgcagatttcagaagattaaaggaactaaaaataaaacgatacggacgggaaataacagaagatgaataccaagaaaagaagaaagaactatcatgcgcaccattcgacgacttcagaaaccgaaccctcgaaaacattgacaaaatatttgtaagcagaccaccccgaaaacgtgcacgaggcacattacatgaagaaaccttttattctatagatgataagaaactgttaaaagcatatggaggaaaagaaggcatgcaacgagcactcagtctggggaaaataagacaaatcggtacaaaaatcgttaaaaatgggacaatggtaagggtagacatattcaaagacaaacgaggacgattctatggggtaccgatatatacaatggactttgcgttaggagtattgcctaataaagcagctgtcagtggaaaagacaaaaacggattaataaaagaatgggccgaaatggactcaggatacgagttctgcttcagcctatttaaagatgacttgattctagtccaaagaaaagaaatgcaagaaccagaattatgttatttcgttagcttcgatagttcaaatgcacagatagacgtaagaagtcacaataaccacttcagtgtactcaacgaaaatcaaaaactcctctttaaatccgcaacacaagcagaagtaataggagaatccataggaatccaaaacctaaaagtatttgaaaaatggcatgtatcaccgttaggagaagtacgaaaagcagaatttagtccacgaggtgaagctaaactgaaaactagcaagaaacgaaagaaatga

SEQ ID NO: 4918 - RNA, 3072 nt, synthetic construct
  misc_feature 1..3072: note = Cas9 variant
  source 1..3072: mol_type = other RNA
atgaaaatctactcatttgatataggagtagcctcgataggatgggctttcatagaaaacgaagtcctacaggattgcggaattcgtatatttacaaaagccgagaatccaaaaaacggtgcgtctttagcattacccagaagagaagccagaggagtacgaaaaagattagcacgaagaagaggtagacttaacacaattaaacaactgttatgtaaagaatttggattacaactcgaggattacctctcaaacgatggtgaactaccaaaagcatacacagcttcgaaagccaatcccttaaaatcaccatacgaacttcgaacattagctttatctcaaaaattagactccaaagacctcgttagagtaatactacacatcgcaaaacataggggatacggaaacaaacacgctaaagattccaaggataccgagtcgggaaaagtaaaaaaggcaatagaattcaatcgaaaaacactagcagaaaaaggatataggtcagtcggggaatacttgtaccgagaattctttcaacaaagcagaatcagccaaaacaacggcgcaacagaatttattaacgtaagaaataaagccggaaactacgagcattgcgttgcccaagacatgctaaaagaagaattagagtctatccttaacgcccaaagacaattcggcttttcactaaaacaagacttcgaatcaaaattattaactaagatatttgaacagcgacctctaaaaagcttcgcagacaaggtcggcaattgctgctttatagcaggcgaaaaacgtgccccaaaagactcaccatcagctatagaattcatcgcattatctagaacaataaacactctgataaacttaagcaaagaaagcggtgaaatatataaccgagctatcatactccaaatcgtagaaagcacactaaaaaaaggcgagatatcatataaagaacttagagaaataataagactagatgaaaggttacgtttcaaagacccacgcttagactactcaagagaaataaaagaggcagagaaagttaaattcctggaatttaaacaattaaaaggtttcaaaaaggcattaggcgaatcgtttacaacactagcaatttcacaattagatgagattgcagaacatatagccctaataaaagacagagtcaaattgaatgaaaagctagaatcatacgccctcacaaaagagcaaagagaggcattatcaaatttaagcttctcagcacacataaatctttcacttcaagcattaaaacaaatactaccattcatgcgtggcgacaatggagaacaatgtttagactatgacgaatccgtggaaaaagccggattaaaagcactctctaaggatacactaaaaggccaaatgctgccgccactaaatgaattcgaaccctatctatctaacccggtagtagcaagagcattagctgaatacagaaaagtattaaatgtattacttaaacaatacggttcaccccataaaattcacatagaatatgctagagaagcaaaactaagctcaactgaaagacaaaaatatgaaaaagaacaaaaagataattatgctgctaaccaggcagcacataaaaaatgtcaagaattaggcttagaaccttctagcacaaatttattaaaactaaaattatggcaagaacagggaggactgtgcctatattcaggagcaaaaataacgatatcatacctccaagatccaacagcactgcaagtagaccatatctacccttattcccgctcatttgacgacagctatatgaacaaatgtttggtactaaccaaagctaaccaggaaaaaggaaatcggactccatttgaagccttcggaacagacagtgcaaaatggggtgtaataaccacattagcccaaaaactaccgcataaaaaaagaagaagaatattaaatacagcattcaatgacaaagaagcaggatttaaacttagaaacttaaacgatacaagctacatagcgagacttgtagctgactacaccgaaacgtacctggaatttctacctcttgtagaatcagagaacacaactttgtcaaaaggccaaaaaggttcaaaaaaacacatagcaatagtaaacggagtactaacaagtactatgaggtactacctaggcttcgcgagtaaggacagagataaccacctacaccatgcccttgatgccgttatcattggattcatgaatgatagcgtcataaaagcctttagcgacttcaaaaaaacacaagagacaagcaaagctgcctattacgcacataccctatctaaacaagaatacaaaaaacaaagagcattcatacaactacccagtggagaaaacttccgagtatcagtattagaaaaagtcgaaagtgtattcgtatcaaaacctcccagaaaaagggtacgaggagccctacacgaagccactttttattcaccaaacgatcccaaactcctaaaaaactacggaggtaccaaaggagtagaacgagctttagctttagggaaaatgagaaaagttggcgcaaaaatagtatcaaatggagcaatggtaagagtagatattttcagacacaaaagcagtggaaaattttatggcgtaccagtgtacactatggactttgcactcggcatattaccaaacaaagccgtcgtcgtaggcaaagaccaaaatggggtcataaaagactggctagaaatggacagttcatacgaatttattttctcactatacaaagacgacgtaatactagtccaaaaaaaagaaatgcaacggccagaattatgttacttcgtatcttttgacacatcaggtgcctcaataaaagtagcaaaacatgataataatttctctaccttaacagaaaatcaaaaattactatttagtaatgctacaaaagaagaggtagtaggtaaaagcataggcattcaaaacctaaaagtgttcgaaaaatggcaagtaagcgtattaggagaagttaaaagaacacaaagttatccgagagaaaatatcagcttagcaagcaaagctaaaaaatga

SEQ ID NO: 4919 - RNA, 3075 nt, synthetic construct
  misc_feature 1..3075: note = Cas9 variant
  source 1..3075: mol_type = other RNA
atgataaggacactgggaatagatatcggaatagcatcaataggatgggcagtaatagaaggagaatatacagataaaggattagaaaataaagaaatagtagcatctggggtaagagtctttacaaaagccgaaaaccccaaaaacaaagaatcattagctctaccgagaacattagccagatcagcccgtagaagaaacgcaagaaaaaaaggcagaatccaacaagtaaaacactacctaagtaaagcattaggactagacctagaatgtttcgttcaaggggaaaaactagcaacactatttcagacctccaaagacttcctcagtccatgggaattaagagaaagggcactataccgtgttctcgataaggaagaactagcaagggttatcctacatatagctaaacgaagaggttatgatgatataacttacggagtagaagataacgattcaggtaagataaaaaaggcaatcgccgaaaacagcaaaagaataaaagaagagcaatgcaaaaccattggagaaatgatgtacaaattatatttccaaaagagcttaaacgtcaggaacaaaaaagaaagttataatcgatgcgtaggaagaagcgaactaagagaggaattaaaaaccattttccaaatacaacaagaactaaaatcaccatgggtcaacgaagaattaatatataaactattaggtaatccagatgcacaaagtaaacaagagagagaaggattaatattttatcagagacctctaaaaggattcggagacaaaattggaaaatgctcacatataaaaaaaggagagaactcaccttaccgggcatgtaaacatgctccatcagctgaagaattcgtcgcactaacaaaatccataaatttcctaaaaaatttaacaaacagacacgggctatgctttagccaagaagatatgtgtgtctacctaggaaaaatactccaagaagctcaaaaaaatgaaaaaggactcacttatagcaaacttaaactattactcgatttaccgagcgacttcgaattcttaggtttagattattcaggtaaaaatccagaaaaagccgttttcttaagtctacccagtacattcaaattaaacaaaataacacaagacagaaagacacaagataaaatcgcaaatatactaggagctaacaaagactgggaagcaatattaaaagaattagagtcactacaactatcaaaagaacaaatacagacaataaaagatgcaaaactaaatttttctaaacatatcaatctcagcttagaagctttataccacttactgcccctgatgagagaaggtaaaagatatgacgaaggagtagaaatactacaagaaagaggcatcttcagcaaacctcaaccaaaaaaccgacaactactacctcccttaagcgaactagcaaaagaagagtcatactttgacatcccaaaccccgtcctaagacgagctttaagtgaatttagaaaagtcgttaacgccctactggagaaatacggcggattccattactttcatatagaattaacaagggacgtgtgcaaagctaaaagtgccaggatgcaactcgaaaaaataaacaaaaaaaacaaatccgagaatgacgcggcatcacaactcctagaggtactaggattacccaatacatacaataaccgactcaaatgcaaactatggaaacaacaagaagaatattgtttatacagtggcgaaaaaattacaatagaccacttgaaagatcaacgagctctacaaatcgaccatgcatttccactttcaagaagtctggatgattcacaatccaacaaagttctatgcctaacgtcatccaatcaagaaaaaagtaacaaaactccctacgaatggctaggatccgacgagaaaaaatgggacatgtacgtaggaagggtatacagctcaaactttagtcccagcaaaaaacgtaaattaacacaaaaaaacttcaaagaacgaaacgaagaagacttcttagcaagaaacctagtagacacaggttacattggaagagtcacaaaagaatatatcaaacattccctatcattcttacctctacccgatggtaaaaaagaacacattagaataatctcaggatccatgacaagtacaatgcgtagcttctggggggtacaagaaaaaaacagagatcaccacctacatcacgcacaggacgcgataattatagcatgtatagaacccagcatgatacaaaaatacacaacatatctaaaagacaaggaaacacatagactaaaaagtcaccaaaaagcacaaatccttcgagaaggtgaccataaattaagcctacgctggcccatgagcaatttcaaagataaaattcaagaatcaatacaaaacataataccaagtcaccacgtatcccacaaagtcaccggagaattacaccaagaaacagtaagaaccaaagaattctactatcaagcgttcggaggagaagaaggagttaaaaaagcattaaaattcggaaaaattcgagagataaaccaaggaatcgtagacaacggtgcaatggttagagtagatatcttcaaatcaaaagacaaaggtaagttttacgctgttcccatttatacatacgatttcgcaataggaaaattacccaacaaagcaattgtccaaggaaaaaaaaatggtataataaaggactggttagaaatggacgagaactacgaattctgtttcagcctcttcaaaaacgattgtataaaaatacaaacaaaagaaatgcaagaggctgtcttagctatctacaaatctacaaactctgccaaagcaacaatcgaactagaacacctaagcaaatacgctttaaaaaacgaagacgaagaaaaaatgttcacagatacagacaaggaaaaaaataaaacaatgacaagagaaagttgcggaatacaaggattgaaagtatttcaaaaggttaaattaagcgtcctgggtgaggtattagaacacaaacctcgtaacagacaaaacatagctttaaaaacgacacctaagcacgtttga

SEQ ID NO: 4920 - RNA, 3078 nt, synthetic construct
  misc_feature 1..3078: note = Cas9 variant
  source 1..3078: mol_type = other RNA
atgggaggatatatgccacaattaatgcgatatcgcctagcattagacattggatcaacatcaattggatgggcaatgataagattatcaatgcaaaatgagccaatagctataataagaatgggcgttaggatattctcagatggaagaaaccccaaagatggatcaagtttagctgtaacccgaagagttgccagacaaatgcgtagacgaagagatagattactaaaaagaaaaacacgtttactaaatgcactggtacaaaagaaatttttccctgaagatgcagatgccagaaaggctttagtagttttgaatccctatgaattacgaaaagaaggcctatataggcaactatcaggcccagagtttggcagagcactctttcatatatcccaaagaaggggttttctatccaacagaaaaacagacaagaaagacaacgacagctcagtcttaaagaaagctatagttgacctcagacaacaactcgaagtagagaattgtcaaactataggggaatggttgtttaaacaacaacaaagtggcaaatcagtcagagcaaggcttagaggaaaaacgcagaaagacaaagcatatgacttttatatagatagagcaatgatagcacacgaatttgacactttatgggtatcacaagctaaatatgatcctttactgtttaacgaagatgccagagcaatactaagagacattctactataccaaagaccgctaaaaccagtgaaacccggtaggtgtactctaataccagacgaatctcgtgctccattagcactacccttaacacaacaagcaagaatataccaagaactaaatcatcttcgcattaccacaccagcgctaggagcacaggctttaacagttgcacaaagaaatacgatagcagcccttctggaaaagagcgacgtaacatttgtaaaaatagccaaagcactcggacttacaagtacaacggagttcaatttacaagacattaaaagagataggttaaaaggtaacgctacagcaattatcttagctagaaaccaatacttcggacgacgatggcatgatttcaatgctgatctacaaaacctaattgtagataaattagttaatgaaggctcagaaacagcattaatagaatggttaaaagcaaatacagacgttgacgaatcagcagctgaaagggtatcaggtgttacactcccagaaggttatgggtccttaagtgtagcagccttaagaagattattaccagcattaaaagaggacgtagtagtatacagcgaagcagtcaaaagagcaggatttgattcacactctgctttaagtttaattgaacaaacaggagagttatatcaagaactaccttactatggagaagtactacaaagacatgtagggttcggatcaggtgatccaaatgatagtccagaacgtcgatttggaaaaattgccaatccaacagtacatatagggttaaatgaactaagaaaaataattaatgcgttaataaaaagatatggaaatccagcagaggtagttgtagagttagcaagggatttaaaactaagtcgagagaaaagaaaagaaatacaagaagaacaaaaacaacgacaagatcgaaacgaaaagagaataaaagatgcttgcgaaattctaggtatagatcctctagtgattgaccgtggcaaaagaagagaaatttctcagaaaatgcaactatgggatgaattaaacccaaaagacgcagcaaatagacgttgcccatatacaggggatcaaatatccatagaaaaattacttagtgcagaagtcgaaatagaacacatattaccattctccaaaacacttgatgacagtttaaataataaaactgtagcaatgaggagagcaaatagagacaaaggaaatcgaacaccatatgaagcattcggagaaagtcttaacccagattatgattatgacgcaatcctacaacgagcatctcttatgcccagagaaaaacgaaaaagattcgctagcgatggttaccaacaatggttacgagatgataaagactttctaagcagagctttaaatgacacggcgtatctgtcgcggatagcaaaagaatatttaacattaatatgccctcctaattcagtacgagccattccaggacgaatgactgcacaattacgagctatgtttggtctaaatagattattatccgaaggcggaatcaaaaatagagaagatcacagacatcacgcaatagatgcagcggtaataggagtaaccgatcaaggactattacaaaaattttccagagcatcagcacgaacacgtgaattacaattaagtagacttgttgatgacatgcctttaccatgggacacatacagagaacacgtcacaagagcattagagcatttagtagtcagtcacaaaccagatcacggatatcaaggcaaaatgcatgaagatactgcttggggattaagggacaacggacaagtaacaagacgtgttcgctcagaagatggaggaccaagacaacgtctcctagaaaataaaaacgtcgttaagataaattcaacacgcgactttagtagacatggaatagatgaacaaggccaagttaacgcatataaggggtacgttggaggaagtaactactgcatagaaatctggatagatgaaaaaggaaaatggaactcagacgtagtatcaacttttcaagcatatcagatagtcagagaattaggtgaaaaggccgcatggcaaaaattacgtaatccattattatccctgagtgcaaaaccactcgttatgagattaatcatagatgatgtagtgaaaatgcaaatagctggacaaaataaaataatgagagttgtgaaaatagcccaaaatggacaaatatttttcgcggaacataatgaagctaacgtagatgctcgagataaggacaaaaacaatccattcaaatatatatcaaaaacggcgggttcgctccaaaaagcaggcggaatacatatggcaatatcgcccatcggtgacgcaagaccggtacgatatggaagatga

SEQ ID NO: 4921 - RNA, 3084 nt, synthetic construct
  misc_feature 1..3084: note = Cas9 variant
  source 1..3084: mol_type = other RNA
atgaaatatacattaggactagacgtaggcactaattcaataggctgggccgtattagaactaaacactaacggagaaccacaaagaatagaaaaattaggaagtagaatattcactgacggaagacacccaaaagatggaaccacactagctagcaaacgaaggcaaaaacgccacgaacgcagaagaagggacagattgcatcaaagaaagaagctagtactcaatcaattagtaagcatgggtctattcccacaatcagaacaagaacaacaagatctaaaaagcctagacgtactaacattacgagcgaacggcgtttcaaaacaactatctgcttatgaactaggaagggtattctactatttaaacttaaaaagaggattcaaaagtaacaggaaaggcggatcagaagaagacaaagctaacaaaatatccgaaagaattaagaaactacaagaacaactaaaagaaaatgatttcaaaacagtaggccaatatttacacgaccggtatataaaaggactatccacaaaagcaacaatagaaaacgactttcacctattaagacaacttatagaagacgagttcgatttcatagtagaaacccaatcaaaattcttccccgaaatctccgatgaacaatggaatacactccggaacagaatgttccatcaaagacccttaaaaccagtggaaacaggcacatgtagtctattcgaagacaagaaacgaacatacaaatacatgccaagttttgaagaatatagattcctaactgaactcttcaacctgtcctatcaagacgaaaactttcactcacattcactatcgtcagaacaaattttcaaagtcttccacgaacttaaaaacacacgagaagcaacatatactaaaataaagaaattattaaaactccccagcgacttaagtttctctatagaaagatcaaaatcaaaagataaaataaaaatctcaactacaaaccacttcttctccaaatcattactattcgcagaagaatgggccagcctagatctaaaactaaaagacgaagtagctgaaatatatttctccgacatgtcggtagaagagattaagaaaggattactccaactaaaaatcgattccgaaatcatagaaaacctcctagaagaaaaagtcccaaacgtacaagaagcgacctgcagctactcaaaagaagcactacagaaaatagtatcattaatcctcgaagaagaacgtcaccccacactaatagtcgacgacctattcaaaaacgaaaaagaagaaacgtcactcatagaccgactagactactacggagcatcaattccagactcaatgcaacctataccacaacatatcaaagacaataacttaacattaaatgaagatgaaaaacgctacgggaaaatcgctaaccccacagtacatgccgctctaaatcaaattcggcaagtcgtaaatgacctcatagaacaatacggaaaaccaacaaacatacacatcgagttcgcaagagatttgaaaaagtctaaagaagaacgagacttcgataaccgaaagaaaaagaaaaacgaagaactaaacgaacaagtaagagacttcatagaaaaacacaatcaaaaaccttctgcctttaatttcgaacgagttaagctatggttcgaactagacgcaatgaataatcaagtatgcgcatactcaggaaaaacaatctctgcacgcatggtactctcagacgaagtccaagtagaccacatcttaccatttagcagaacattagacgattccttagcgaataaggtgttagtattagcttcggaaaatgtaaagaaacgtaatagaaccccatacgaagccttcggtcaagatacagaaaaatgggcatcaattcaagaattagccaaaagactaccatatcacaaacaatggagatttgcagaagacgctattaagaaatttgaagaaaaagatcaattcctacaaagacatctcaatgatacaagatatatatccaaaatagcaaagaaatatttaggctctatcaccgatccatataaaatagtcgcatcacgaggccaaatgacatccataataaggggtaaattaggactaaatcaatttatccaaaaacccgatggaaccaaaaatagagaagatcatagacatcatgctatcgacgccttaacagtagcgctaacatcccgaagttacctaaaacgaatcagtgacgcatcagcaagaaatcaagaccccaacagaatacccatacccgaaccatggaaaggctttataaaagacgcagacgtcaaattcaatgaaataatagtttcccacaaagtcgaccatggtaaaaacggaccattcatggaagaaacatgttttggtttgatcaaaaaccccaataaatatgaagaagaaaacgacttcaaactaatcacaacaaaatcattagactccgtcaaagacccatctacgattagaagtcagagcttgcaaaacttagcagaaaaatctggagtaatctccttggccaaatcaggggtaaagaaactacgtgtctatgacgtaaccaaagaaaatcctgctgacatcggtttaatagaaagtggactggccaaaataactcacggaaaagataaacaacacgttaaacattaccaaaaaggagacataaattacttagcaatctggtgtctaccgcaaaatataaccttaaaatcagacaaccacaagaaacgcaaaacagattatatatttacagcaataaagacatttgacctaaacagtaaaaatccaaatgatctaagaccccatcctgcagcaaaattagtaacaaaagtctataaaggcgacacagtagctttagaagtaaataaccaattaaactactacattgtaaaatcaatacgagcagcaaataaaaagctatatttcctaaaaatcaatcaatcttccgaattagccaacgaaacacaattcatacccgcatacaccaagctagtagactataaattccgaaaagtctcagtatcacctaccggcgtaataacagataatggaccactactaaaatga

SEQ ID NO: 4922 - RNA, 3090 nt, synthetic construct
  misc_feature 1..3090: note = Cas9 variant
  source 1..3090: mol_type = other RNA
atgaggagccttagatatagattagcattagacttgggatcaacgagtctaggatgggcactgttccgtttagatgcatgtaatagaccaacagcagtaataaaagctggagtgagaatattttcagatggaaggaatccgaaggatggttccagcctagccgttacaaggagagcggctagagcaatgagaagaaggagggacaggctattaaaaagaaaaacaagaatgcaagcaaagttggtggaacacggcttctttccggcagacgcaggaaaacgaaaagctctagaacaacttaatccttacgcattaagagcaaaagggctccaagaagcattattgccaggcgaatttgcacgagcattatttcacattaaccaaagacgaggattcaaaagtaataggaaaacggataagaaagacaacgactcaggtgtattaaagaaagctattggacaactgagacagcaaatggctgagcaaggaagtagaacagtgggagaatacttatggacacgattacaacaaggtcaaggcgtaagagcaaggtaccgtgagaaaccatatactactgaagaaggaaagaaaagaatagataaatcttatgatctatatattgatagagcaatgattgagcaggagttcgacgctttatgggcagcacaagctgcttttaaccctaccttattccatgaagctgctcgagcagatttaaaagatacactcttacaccaaaggcccttaagaccagtaaaaccaggccgatgtactcttttgcccgaagaagaaagggcacccttagcacttcccagcacccaaagattccgcattcatcaagaagtaaatcatttaagattattagatgaaaatctaagagaagttgccctaacactggcccaacgagatgcagtagtaacagctctagaaaccaaagctaaattaagtttcgaacaaattagaaaactactaaaactttcaggctctgtacagttcaatttagaagacgcaaaacgaacggaactaaaaggcaacgcaacatcagccgcattggcaagaaaagaactatttggtgcagcgtggtcaggatttgatgaagcgctacaagacgaaatagtatggcaacttgtaacagaagaaggagaaggagcattgatagcatggttacagacacacactggtgtagacgaagcaagagcacaagcgatcgttgatgtcagccttccagaaggatacggtaatctatctcggaaagcattagcgagaatagtaccagctttaagagcagccgtaatcacatatgataaagctgtacaggctgcaggattcgaccaccattcacaacttggcttcgagtacgacgcatccgaagtagaagacttagttcacccagaaacaggggagattagatctgtatttaaacaactcccatactatggtaaagcactacaaagacatgtagcttttggaagtgggaaaccagaggatccggatgagaaaagatacgggaagatagcaaatccaaccgttcatataggattaaatcaagtacgaatggtggtaaatgcgttaatacggagatacggaagacctacagaagtcgtaatagaattagcaagggaccttaagcaaagcagagaacaaaaggtcgaagctcaaagaagacaggcagataatcaaagaagaaatgcaagaatacgacgaagcatagcagaagtattaggcataggcgaagaaagggtaagaggttctgatattcaaaaatggatatgttgggaagaattaagtttcgacgcagcagatcgaagatgtccgtatagtggagtacaaatatcagcagcaatgttgttatcagatgaagtagaagtagaacatatactaccgttttcaaaaacccttgacgatagcctaaataatagaacagtagcaatgcgacaagcaaacagaattaaaagaaacagaaccccatgggatgcacgcgctgaatttgaagctcaaggctggtcatacgaagatatattacaacgggcagaaaggatgcccctaagaaaaagatacagattcgcaccggatggatatgaaagatggttaggagacgacaaagattttctcgcccgagctctaaacgatactagatatctatctagagttgcagcagaatatctaagattagtatgtcctggtacccgtgttatcccagggcaactaacggcattgctaagaggaaaatttgggttaaatgatgtattaggattagatggagagaaaaatcgtaacgatcatagacaccatgcagtagatgcatgtgtcataggtgtaacagatcaaggacttatgcaaagattcgcaactgcctcagcacaggcaagaggtgatgggttaaccagattagtcgacggaatgccaatgccttggccaacctatagagatcatgttgaaagagcagtcagacatatctgggtttcacatagaccagaccacggattcgaaggggcaatgatggaagaaacttcatatggaatacgaaaggatggatccattaaacaaagaagaaaagcagatggatcagcaggtcgtgaaataagtaatttaatacgaatacacgaagcaacccagccattacgacatggagtatccgcagatggccaaccattagcatacaaaggatatgtaggagggagtaattactgcattgaaattacagtcaatgataaaggaaaatgggaaggagaagtaatatcaacttttagggcatatggagtagtaagggcgggaggaatgggacggctacgaaacccccatgaaggtcaaaatggaagaaagttaataatgagattggtaatcggggattctgtacgcttagaagttgatggagcagaacgtacaatgagaattgttaaaatctcagggtcaaatggtcagatatttatggccccaattcacgaagcaaatgtagatgctagaaataccgacaaacaagacgctttcacatatacaagtaaatacgctgggagcttacagaaagcaaagactaggagagtgacaatctcgccgataggcgaagtcagagatcccggcttcaaaggttga

SEQ ID NO: 4923 - RNA, 3090 nt, synthetic construct
  misc_feature 1..3090: note = Cas9 variant
  source 1..3090: mol_type = other RNA
atgaaataccgacttgccttagatttaggaagtacgtcactaggatgggctatagtccaactcaatgccaaagatgaaccttgtgcgattgtacgagctggagttagaatttttcctgatggaagaaacccaaaagatggttccagtttggcagtcacacgaagaaatgcaagggctatgcgaagaaggcgagacagacttctgaaaagaaaagcaagaatgcaaagactattgatagaacatgatctctttccagcagatgaagcagcaagaaaggcgttagagaccctgaatccatatgagctaagagctaaaggattagatgcagcacttacaccagctgaatttgctagagctctatttcatttaaatcaaaggagaggattcaaaagtaacagacgcaccgatagaaaagacaatgactctggagccttaaaagcggccatagggggtctacgagctcaactagatacagcgggagcggacggcagagcaagaaccgtaggtgaactattatggagaagaatgagcgatccaaatgtcttaacggtccgagcaagatatagggaacaaagaataaccaaagatgacggaaagacaagagtggacaaatcatacgatttatatgtagatagggctatggtcgaagcagaatttgatgcattatgggcaaaacaagcagaactaagccctacacaatttggggaagcagctcgagcaaccttaaaagactgtttattacatcaacgtaatttaagaccggttagaccaggaaggtgtacgttagaaccagacgaaccacgggctcctttagcattaccatcccaacaaagatttagaatacttcaagaagtaaatcatctaagattattaggaggcagactactagaagagagtttatcagtagagcaaagagacaaattagtagctgctttggaagatggctcaaaatcatttaaaacggccataccaaaattacttggattaccggggacagtccaatttaatctagcagacgcaaaaagaacagaacttaagggtaatgcaacgagtatgctactcggcaagaaagactttttcggtccagcgtggcatggatttagcgaagcacgacaagatgaaattgtgatgagaatacaagaagaagaatcggaagccagactcgtagattggctagcaacatcaaccggagtcgatgaagctcatgcgcttaaaatagctaatgcagcgctaccagaagggtatggaagcctaagtgcaaaagcactggcaaagatcttaccagcgatgagagcagaagtaatcacgtacgataaagctgttttagcagcaggatatgatcatcattcacacataagccatgcagcttcaacgggtgaaatattaccagaattaccatactatggagaatacttacagagacacgtaggattcggaactggggaattaaacgatacccctgaaaagaggtttggacggatcgcaaatccaacagtccatataggacttaatcaagttagagtagtagttaatgcattgataaaaagatatggacatccaacagaggtcatagtagaagttgcaagagaccttaaacaaagccaagatcaaaggagagagacacaagaacaacaagctaaaaatcagaaaagaaatgaaagattaagaaaagatgcagctgcgatactaggaatagcagacgagagagtacgattagccgacatacaaaaattaatattatgggaagaattgagttttgacatagcagaccgtagatgtccatatagtggagttcaactaagcgcagccatggtattatcagaacaagtagaaatagaacacattttgccttttagcatgactttggatgatagcttgaacaacaaaaccgtcgctatgaggttagtgaacagattaaaggggaatagaacaccatgggatgctagggaagcatttgccggccaaggatgggattatgacgggatattaatgagagcggaacgtatgccacgagcgaaaagacaaagatttgcacctgacgggcttgaaaaatggttgaaagaagacaaagatttcttggccagggcattaaatgacactagacacctaagcagagtagcgagggaatatctcagcctggtttgtcctgcatcgacaagagtaatacccggacaaatgacagcaatgctaagagctaaattcggtctaaatgacatactaggacttaatggcgaaaagaacagaaatgatcatagacatcatgcagtagatgcatgtgtagtagcggttacggaccagggattattacagaggtttgcccaagcctcagcagacgcacgaggcaaaggtttagatcgtctcgtagaaaccatgccagatccatgggacagctatagagaacacgtgcaacgagctgttaatagcatatgggttagccacaagccggaccatggatttgaaggagctatgcacgaagatacaacatatcgtccaccacacttagacccgaaaaacatgtggagaacgagagggataggaggtggaaaaccaaacgaaaaagaagccgacagcaaggcaatggtaggatttacaggacctgaacatctacagagacatcatagagataaagccggtcaacaactgccatataaaggctatgtagcatcacccaaattttgtatggatatagttcggaatgacaaaggaagatgggaaggagaagttgtgtcaacatttgaagcgtataggttagtaagtgaatttggacgagatgcagctctagcccatatacaatcaaaaagtagaagcatatcaggcaagccactcgtaatgagactgcaaggaggagatatggtacgatttgatgacgatgaagggcgaccagtagttcttagggttgtcaatatgactggtaatggacaaatattctttgctccacataatgaagcaaacggagatgcgagaaaccgagataaacaagatcaatttgtttatttatcaaaatacgcagggagcttacagaaagcaagaggccgcagagtaaccgtcagcccagcaggagaattaagagaccctggatttaaagaatga

SEQ ID NO: 4924 - RNA, 3090 nt, synthetic construct
  misc_feature 1..3090: note = Cas9 variant
  source 1..3090: mol_type = other RNA
atgcgaagtttacgttacagattagcacttgatttaggaagcacaagtctaggttgggcactattcagactggatgcttgtaacagacctacagcagtgataaaggcaggagtacgaatcttcagtgatggaaggaatccaaaagatggttcatccttagcagtaacaaggcgtgctgccagagcaatgcgaagaagaagagataggttattaaaaagaaaaacaagaatgcaagctaaactggtcgaacatggtttctttcctgccgatgcaggaaaaagaaaagcactagaacaattaaatccatacgccctaagagcgaaaggattacaagaagcccttctacccggagaatttgcaagagctctgttccacataaatcaaagacgtggatttaagagtaatagaaagaccgataaaaaggataatgactcaggtgcattaaagaaagcaataggacaactaaggcaacaaatggcagaacaaggatcaagaacagtaggagaatatctttggacaaggttacaacaaggtcaaggagtaagagctcgatatagagagaaaccctatacaaccgaagaaggtaagaaaaggatagataaaagttatgacttatacatcgacagagctatgattgaacaagaatttgacgccctatgggcggcccaagcagcatttaaccctacgttatttcacgaagccgcacgggcggatttaaaagataccctactccaccaaaggccattgagaccagtaaaaccaggacgatgtactttactacctgaagaggaacgagccccattagcattaccatctacacagagattcaggatacatcaagaagtcaatcatctacgattacttgatgaaaatctaagggaagtagcgcttacacttgctcaaagagatgcggtagtaacagcgttagagacaaaagcgaaattatcatttgaacaaatacgtaaattattaaaattatcaggatcggtacagtttaatttagaggatgccaaaagaacagagttaaaaggtaatgctaccagtgctgccttagcaaggaaagaattgtttggtgcggcttggtctggatttgatgaggctttgcaagacgaaattgtttggcaattagtaactgaagaaggggaaggcgcgctaattgcatggttacaaacccatacaggtgtagatgaggcacgagcacaggcaatagtagatgtatcgcttcctgaaggatacggtaatctatcaaggaaagcattagccagaatagtacctgcactacgagcagcagtaataacatatgataaagcagtgcaagcagctggttttgatcatcactcacaattgggcttcgaatacgacgcatcagaggtagaagacctagtacatccagaaacaggtgaaataagatcagtatttaaacaacttccatattacggaaaagcccttcaaaggcacgttgcttttggctcaggtaaaccagaagacccagacgagaaaagatatggaaagatagcaaatcctacagtgcatataggtttaaaccaagtaaggatggtcgtcaatgcactgattaggagatatggaagaccaactgaagtagtaatagaactcgcacgagatttaaaacaaagtagggaacaaaaagtagaggcacaaaggcgacaagctgataatcaaaggagaaatgcacgcataagaagatctatagcagaagtattgggaataggagaagaaagagtgcgaggaagtgacatacaaaaatggatttgctgggaagaactcagctttgacgcagctgataggcgatgtccatactccggggtgcaaataagtgctgcaatgttattatcagatgaagtagaagtggaacatatactaccattcagcaaaacattggatgatagtttaaataatcgaacggtagctatgaggcaagcaaacagaataaagcgaaatcgaacgccatgggatgcgcgagcggaatttgaagcacaaggatggtcgtacgaagatatattacaaagagccgaacgaatgcccctcaggaaacgatatcgattcgcaccggatggttatgaaagatggttgggtgacgataaagactttctagccagagctttaaatgacactaggtacttatcaagagtagcagcggaatacttacgattagtatgcccaggtacgagggtaatacccggacagttaacggcattgctcaggggaaagtttggcttaaacgatgtattaggcttagacggggagaaaaatagaaatgaccatcgacaccacgcagtagacgcttgtgttattggtgtaacagatcaaggtttaatgcaaaggtttgctacagcaagtgctcaagcacgaggagatggtctaactagattggtagatggaatgcctatgccttggccgacttacagagaccatgtagaaagggctgtacgtcatatatgggtaagtcatcgaccagaccatggattcgaaggagctatgatggaagaaacctcatatggaataagaaaagatggatccattaaacaaagaagaaaagcagatggctcagctggcagggaaataagtaatctaataaggattcatgaagcaacacaaccactaagacatggtgtctctgctgatggacaaccattagcatataaaggatacgtaggaggttccaattattgcatagaaattaccgtaaatgataagggcaaatgggagggagaagtgatttcaacatttagagcatatggaatagtaagagcgggaggtatgggacgattacgtaatccccacgagggtcagaatgggcgcaaattgataatgagattagttataggagactcggtaagactagaagtagatggagcagaaagaacaatgcgaatagtaaaaataagcggaagcaatggacagatatttatggcaccaatacacgaagcaaatgtagacgcaagaaatacagataaacaagatgcgtttacatatacatctaaatatgcaggaagtctacagaaagcgaaaacgagaagagtcacgatatcacctataggtgaagtaagagatccaggctttaaaggatga

SEQ ID NO: 4925 - RNA, 3096 nt, synthetic construct
  misc_feature 1..3096: note = Cas9 variant
  source 1..3096: mol_type = other RNA
atgccagcaatctacaggttggcattagacctgggaagcactagccttggatgggcggtactcagactagaaccggcagcgctagaaccgatagcaataatcaaagcgggcgtgagaatttttagcgatggtagaaatcccaaagatggcgcaagtttagctgtaacacggagagctgcaagggctatgagacgtagaagagatagattactcaaaaggaaagcaagaatgcaagacaaattggtaaaacatgggttctttccatcagatatggatgaaagaaaagcacttgaaagactagatccatatgctttaagggctaaagggttacgtgaagcattaactccaggtgaatttgcacgtgcattgtttcacattaatcaacgaagaggatttaaatctaatagaaaaacagataagaaagacaatgactcaggtgcgctaaagaaagctatatcgcatttacggcaacaaatggaagcaggaggacacagaaccgtaggtgatcacctatggtcaagactgcaacaaggattgggcgtaagagctcgttatcgagaaacaccatttactaatgatgaaggtaagaaaagaattgataaatcatatgatctatacatagaccgcgccatgatagagcaagaatttgatgcactatgggcagctcaagctgctttcaatccggctttattccatgaagtagcaagggcagatctaaaagatacactattacaccaaagaaggctaagaccagtcaaacctggtagatgtacactgttaccagaggaagaaagagcacctctagcacttccatcaacacaacgattccgtatatatcaagaagttaatcatctacgcctattaggagaggacttacgggaagtagcattaacactcgcgcaaagggatgcagttgcaaacgccttggaaagcaaagctcgactaacttttgagcagataagaaagttattaaaactatcaggaagtgttcaatttaatcttgaagatgcaaaaaggacagaactcaaagggaatgcaacatcagctgccttggcaagaaaagaactcttcggtgcagcatggggaggatttggagaagctctacaagacgaaatcgtatggcagctagtgacagaagaaggagagggagcattaattgcatggctacaagctcatacaggagtagacgaagctagagcacaagcaattgctgatgcgagtttacccgaaggatatggtagcctaagtagaaaagctctggctagaattgtacccgccttaagagcaggcgtagtaacatatgacaaagccgtacaagctgcaggattcgaccaccactcacaactaggatttgaatacgatgctggagaagtagaagattgggttcatccagacactggcgagatacgaccagtattcaaacaattaccttattacggaaaaccactccaacgacacgtcgcttttggatcagggaaacctgaagacccagatgaaagacgatatggaaaaatcgcaaacccaaccgtccatataggattaaatcaagtccgaacagtagtaaatgctttaatcagacgatatggtcggcctacggaagtagtaatagaattagcaagagatctcaaacaatcgagagaacaaaaagtagaagcacaaagaaaacaagcagaaaatcaaagacgaaatgcaagaataaggaagtcgattgcagaggtactcggaattggagaggaacaagttagaggagcagatatccaaaaatggatctgctgggaagaactatctttcgacgttgctgaaaggagatgcccatactcgggagttcaaataagtgcaaggatgttattaagtgacgaagtagaagttgaacatatccttccttttagtaaaactctagacgatagtttaaacaatagaactgtagcgatgaggcaagcgaaccggataaaacggaacagaacgccttggactgcaagagacgatttcgaagcacaaggatggagctatgaaggaatattacaacgagcagaaagaatgccattaagaaaaagatatagatttgcgccagatggatatgaaaggtggctaggagatgacaaagattttctcgccagagcactcaatgatacaagatatttaagtcgagtcgcagcggaatatttgaggttagtatgcccgggatcaggcacgagagtaatcccaggacaaatgactgccagactaagagggaaatttggtttaaacggagttcttggtccagacggcgagaaaaaccgcaatgaccatcgccaccacgctgtagacgcatgcgtgattggtgttactgatcaaggattgatgcaaagattcgcgaacgcaagtgctcaagcaagggaagatggactaaccagattggtagatgatatgcctagaccgtggccaacttacagggcgcatgtagaaagggctgtaagacatatttgggtctcacacagaccggatcatggctttgaaggagcaatgatggaagaaacgtcatatggaataggaaaggacggaagcataaaacaaagaagaaaagctgatggctcaccaggccgagaaattacaaatctaataagaatccatgaagcaacacaaccacagcggcatggagctggaccagatggacagccactaccatataaaggatacgtaggagggagtaattattgcatagaaataacaagaaatgataaaggaaagtgggaaggagaggttatttctacttttagagcatatggcattgtaagaacatcaggcctagggcaacttagacatcctagagtaggccaaaatggaagagagctagtgatgcgtttagtgatcggagactcagtacgattggaaattgacggaatagaaagaacaatgagaatagtaaaaataagtggatcaaatggtcaaatatttatggcacctattcatgaagcaaatgtagacgctcgcaatagtgataagcaagatgcatttgcgtacacatcaaaatatgcaggttcgttacagaaaacgaaagccagatttgtcactatatcgccaataggagaagtaagagatttgggcttcaaaggatga

SEQ ID NO: 4926 - RNA, 3099 nt, synthetic construct
  misc_feature 1..3099: note = Cas9 variant
  source 1..3099: mol_type = other RNA
atgaaaaaaagaatattaggactcgacataggaatagccagtgtaggttgggcgctagtcgaatttgacgatgaatttcaagataataaaaaaaaaggaacaataataaaaagcggcgtaaggatattcacacgggcagaaacacctaaagaaagagaatcactagctaaaccccgtagggaagcacgttcccaaagaagacgaatacgaagacgtgtagaaagattaaacagcattagggaattatttgtaaaaaacggagtagtggaggaatggtcagtatcaaaaaaaaacccaaataatatatacatcaccctaaaccaaataaagaccccatggcaattaaggatggaaagccttgacagaaaattaaccaatgaacagtttgctgtagtcctaacacatttagcaaaacacagaggatataaaagcctacgaaaagatgataaagcaggaaaagtcctggaagcaatatcacaaaataaaaaaagacttaatgacagcgactatcgaacattaggtgaaatgttttgtaagaacgaaagctataaagaacacaagcgtaacaagggcggagagtacataaattcagtagcacgagaattaattgaagaagaagtagaaaaaattttcgtaaaacagagagaaaagggcaacaacttcgcagatgtcaatacagaaagagaatacctaaaaattgccttctcacagaaaccagccggtagcatatcaaaaatggttggtttctgcacattcgaaaacggagaaaaacgagcaccaagagattcatacagcgccgaactattcaaagtgctatgtacaataaacaacacaacgtttacggatatgaaaacaggagaaataagatcctttagcaaagaggaaataggaaagactctagagacagtaaaaaacgtcaaagatgtaaaatatgcaaaaataagaaaagatctaggcttagaagatagcgtaaaattcagtggagtcgactatcgcgaaaatgctaaaagtaaaggcgaaggtgaaatatttgtaagcatgaaaacctatcacgaaattaaatccaaaatagaaaaactatcaaaagaaaaatgggataacctaaagggtaataccgaattactagactcaatcgtaaatataatagctaacttgaaagacgatgaaagtataaaaaaagaattccaaaaacttaaaatagacgaagacatcatagatgtattactaaacttcgaattcaaaaaatttatcaacctatcattcaaagcactaagaaaaataataccattccagttccaagggcaaaaatacataacagcctcgacatccgcaggttattcactcaagcaagaaggaatcaaaaataaattagttccgccagcaaaagaaaacataaatgtggcagtggtagcaagagcctttgctcaaacacgcaaagtaataaacgccgtaataagaaagtacggacagtttgaccagatcaatatagaactggcaactgaattgaaaaactccaaattcgaccgatcaaaaatagaggagggacaaaagaaattccaatcacaaaaagataaaatatttaaagaagtacaagaactacgcggagggatgacgccatcatcctctttactcctaaaatacagattatggcgagaacaagacgagagatgcgtatacagcggaaggaaaatatctttcgaagatctattagacaccggatttctagacatagatcatataataccgtacagcaaatcaatggacgattccttcaacaacaaagtcctatgtctagcagaagaaaatcgaaacaaaaaaaatgatataccatttaactactaccaaagaatagatcgagattggaacctattaataagtatcataactagcatgaaaaacatgaaaatagccaaaaaaagcagattactaaaacaggagttaagcgatatagaaggcttcatagaaaggaatataaatgacacaagatatgctacaagatatatcaaagattttctagaaaataatttagaattcaaagaaaacgaattcataaaagtaaaagtacaagctcgatccggtggattaacatcagtcttaagttacaactggggtatgagcaaggacagagaagaaagttacttccaccatgctaaagatgcaataatagtagcctgtagcacacaagggatggtacaatatatttcaaaaataagccaacaatacgaaaatgacaaagacaagatgaaaaaaataaaggataaaacagaaaattgtatccccaaaccgtgggactcattccgagctgatgtcgaagaatctatagaaggtatatttgttagttttgcgccaagacacaaagttacaggtagcgcacataaagaaactatatatagcaaaaaacatctcgaaaaagaaaggtatgttacagtaaaaaagtcattagataaaataaaactatccgacctagaaaacataccatgtaatgaaaactgcggtatcatacgagttctaaaagagaggctagaaaaattcaaaaacgatagtttaaaagcatttgcagacccagtacacatgccaaccaaatgcccgaacaaaaaaggaccagtaatccggagcgtaaaaataaaagaatcaaacaaaacaggcatagaagtgagaaaaggattggcagaacgtggtgaaatggtaagagttgatgtgtttataaaagataaaaaatattatctagtcccaatatacgtctcagatttcaaaaataaagatttaccaaataaagcaatcgcagctttaaaacttgaaaatgaatggatcatgatagacaaaacctatagctttaaattctcactatttaaagacgaccttataaaaataaaaaaaaaaaaagaagagatcttcggttactttggcggagtgcatcgcagcactggaacaataaaaattaagagcagacacaaacctaaagaaatagatgaagggataggatcacgatgcctattagacttcaggaagtttcaagtagacgtactcggcaactacaccgaagtaaaacacgagaaaagaatgcctgcatatataacaagaaaagacaaaaaacactga

SEQ ID NO: 4927 - RNA, 3105 nt, synthetic construct
  misc_feature 1..3105: note = Cas9 variant
  source 1..3105: mol_type = other RNA
atgaaaattttaggattcgacatagggatagcaagtataggatgggcatttgtcgaaaacggagaactcagggattgtggggttcgaatattcacaaaagcagaaaacccaaaaacaggagactcactagcaatgccgcgaagagaggcaagaagcgtcaggaggcgacttgcaaggagaaaagggcgattagaaacattaaaaagactacttgcaaaagaatgggatctatgctatgaagactacatagcagcagatggggaactacccaaagcattcatgggtaaaaacctaacaaacccatacgttctacggtacgaagcattacagagactcctgggaaaggaagagctagcaagagtaatattacacatagctaaacatagaggctacggtaataaaaacgcaaaaataacaaaatctgaagagtcaaaaagagaacaaggaaaaatattatcagcactcgccaccaacgcaagcgtaattgctagatatagaacagtaggtgaatatttttataaagaattctgtgaggtaataaaaaacccccaaggattaaacaccaatgaaaattgtacgcaaccaaaagtcagagtactaaaaccaatccgcaacaaaggaggtgaatacacaaactgcatactacaagaagacttacagagagagttacgatgtatatttgaacatcaaaaaggatttgggtttccaataactcaagaatttcaagacaaaattcttaaaatagcattttatcaaaggtcacttaaagacttctcacatctcgtaggaaaatgcacattttatcctgatgaaccccgtgcaccaaaattcagtctatcagctatagaatttataacaaaagcaaagacgatcaatctccttgtaggaattgtgaaggaaagtggtgaagtctgggataaagaacaatggagagagcgtcttgattccgttttcagcgccgtctgcgaaagaggaaatctaacattcgcacaaatgcgaaaaattttgaaaatagacgaacgaatacaatttaaagaagtagattatacggctaaaaatcccgaaaacaaaaaatttgtcgaatttaaaaatctaaaaaaattttgtgaaatcttaggcgcaatagttggagacagagcactagctgattctattgcgcgagacatgaccctgatcaaagatgaagaagagctagcgcaaaaactacgaggatatggaaaattttcccaagaacaaatcacacaactcggcgcattaaactttagtcaccatataaacttatcactcaaagcactaagtgaaatactaccttttatgcgagagggaatgcgttatgatgaagcatgtcaagaagccaagctccaagctaagcacaacgacaaaaaaagtaagttcctacctcccttttgtggatctatctatgcggacgagcttacaaatccagtagtacatagagcgatagcagaatacagaaaaatattaaacgcacttatagccaaatatggcaacgttcacaaaattcacatagaactaactagagatgtaggtaagaattttcaggaaagagaaaaatataaaaaagaaatagaaagcaactacaaagcaagagtacaagcaatgcaagaatgtgaaaaacttggattaacattatcagagggtaatatattaaaactacgcctattcatggagcaaaatgaaagatgcgtatattcaggtagaaagatcaccctagcaaaccttaaagaacaaggggccttagaaatagaccatatcctaccatatagcagatcctcagatgactcatacatgaacaaagtcctagtattcacaaacgaaaaccaaaacaaggggaacaaaactccatatgaagcatttggtggagactcacaaaaatggggggaaatagaaagtttagccttacgatctggataccccaaaaaaaaagcaaaaagaatactcgacaagggatttggggaccgggaagctggattcaaatcaagaaatatagttgactcgggatatatcgcaagattaatagcaaactatacaaaagaatacctaaaatttctaccactagattcacatgaaaatacagcactaatcgctggcgaaaaagattcaaagatacatgtagaagcagtcaaaggaatgttaactgcaactatgaggcatttctggggactgggatcaaaaaacagatatgaacatacacaccacgcaatagacgcaattataatagcatatatcaacgccgcaatgatacaaagattcagtcaatttcgacaaaaccaagagtcactaaaagcacgcttctatgctaaagaattagcgaaggaagaattcaaaacacaaagagcattctttgagccatttagtggattcagagaacaagtattagctaaagtaggtcaaatattcgtatcccgacctcccagaaagcgagcgcgtggagcattacatgaagaaaccttttattcaatagatgacaaaaaattgtcagaaacatatggcggaaaggaaggagtacaaagagcgctcagcctaggaaagataagacaaataggaacaaaaatagtagcaaacggaccgatggtacgagtagatatttttaaacataaaaagtcaggaaggttttacgcagtgcccatatacactatggatttcgcactgggcatactgccaaataaagctgtggtctctggaaaagacaatgatagaataattaaagactggttagaaatggacagtaactacgaattttgttttagcttgtttaaagatgacgtaatagaagttcaaaaaaaagatatggagaaaccagaattagcatatttcgtttcattaaacacttcatcagcaagcatagcactcgtaaaacatgacaataaattcgaaacactgactagtaaccaagcaaaattatttagcaatgcgaaagaaaacaacgtaattgcagaatcattgggtatacaaaatctcaaagtattcaaaaaatataaagtatcacctctcggagaaatcaaagaagccaaatacgaaccaaggcaaccaatagcactaaagacatcaccaaagaaacatagaaaacaaaataacgcacaatga

SEQ ID NO: 4928 - RNA, 3108 nt, synthetic construct
  misc_feature 1..3108: note = Cas9 variant
  source 1..3108: mol_type = other RNA
atgagacgattaggtttggacttaggtacaaacagcataggatggtgccttttagacttaggagatgatggagaacccgtttcaatattcagaacaggtgcaagaatattttcagatggtcgcgatcctaaaagtttgggatcattaaaagcaacacgtagggaagcaagactaactagaagacggagagatagatttatacaaagacaaaaaaatctaataaatgcattagtcaaatatggtttaatgccagcagacgaaatacaaagacaagcgctagcatataaagacccatatcctatacgtaagaaagcactagatgaagccatagatccatatgaaatgggaagagcaatatttcacattaatcaaagacggggttttaaatcaaaccgtaagtcagcagataatgaagcaggagttgtaaaacaaagcattgcagacctggaaatgaaattaggagaagctggagctcgaacaataggagaattccttgccgatcgacaagctaccaacgacactgtaagagcaagacgactaagtggaacaaacgcattatacgaattttatccagaccgctatatgttagaacaagaatttgatacactgtgggctaaacaagcagcatttaaccccagtttatatatagaagcggcacgagaaagattgaaagaaatagtattttttcaaaggaaattaaaaccacaagaagttggacgatgcatttttttaagtgatgaagacagaataagtaaagcactaccatcatttcagagatttagaatttatcaagaactatcaaatcttgcatggatagatcacgatggcgtagcacaccgaatcacagctagtctagctttaagagatcatttgtttgacgaattagaacataaaaaaaaactaacatttaaagcaatgagagcgattctaagaaaacaaggtgtagtcgactatccagttggattcaatctagaaagcgataatcgagatcacctaataggtaatttgacatcatgtattatgcgagatgcaaaaaaaatgattggctctgcatgggatagattagacgaggaagaacaagattcctttattctaatgttacaagacgatcaaaaaggggacgatgaagtcaggtcaatattgactcaacaatacggactcagtgacgatgttgcagaagactgcctagatgtgagactgccagatggacatggaagtttatccaaaaaagcaatagatagaatattaccagtacttagagatcaaggattgatttattatgacgcagttaaagaagcagggctaggtgaagccaatctctacgacccttatgccgcactctcagataaactagattattacggaaaagctctagcaggccatgtcatgggagcgtctggcaaatttgaagattctgatgaaaaaagatacgggaccatcagtaatccaacagtacacatagcactcaatcaagttagggcagtagtcaatgagttaatcagacttcacgggaaaccagatgaagtagtaatagaaataggcagagacttgccaatgggcgctgacggaaaacgagaacttgaaagattccaaaaagaaggcagggcaaaaaacgaaagagcaagagacgaattaaaaaagctaggacatatagactctagggaaagtaggcaaaaatttcaactatgggaacaattggctaaagaaccggtagaccgttgttgcccatttacaggaaaaatgatgtccatttcagatttgttctcagataaggttgaaatcgaacatttattaccttttagtctcactttagatgactctatggcaaataagactgtatgttttcgacaagctaacagagacaagggaaatagagcacctttcgatgctttcggaaactcaccagcaggatatgattggcaagaaattctaggacgaagtcaaaatttaccatacgcgaaaagatggagattcttaccagacgccatgaaaagatttgaagcagatggaggttttctggaaagacaactaaatgacactagatatatttctcgttacacaacagaatacatctcaacaatcatacctaaaaataaaatctgggtagtaacgggacgacttacatcgttactacgcggtttctggggattaaacagtatactaaggggacataatactgacgacggaacaccggcaaaaaaatcaagagatgatcatcgacatcatgcgatagatgcaatagttgtaggaatgaccagccggggactgttacagaaagtatctaaagccgccagaagatcagaagatctagatctaacgagattgttcgaaggacgaattgatccttgggatggatttcgtgacgaagtaaaaaaacacatagatgcaataatagtaagccatcgacccagaaaaaaaagtcaaggggctttacataatgataccgcatacggtatcgttgaacatgcagaaaatggtgcaagtaccgtagtacatcgtgtacctatcaccagtttaggtaaacaaagcgatatagaaaaagtaagagatccactcataaaatcagcattgctcaatgaaacggcaggattatcaggaaaaagtttcgaaaatgcagtacaaaaatggtgtgcagataacagtataaaatcgctaagaatagttgaaaccgtaagtataattccaatcactgacaaagaaggtgtagcatataaaggatacaaaggagatggaaatgcatacatggatatataccaagatccaacatcaagtaaatggaaaggggaaatagtttctcgctttgatgcaaaccaaaagggtttcataccatcatggcagtcgcaatttccaacagctcgattaataatgcgactaagaataaacgatttactaaaattacaagatggcgagatagaagagatatatagagtgcaacgactaagtggttcaaaaatacttatggcaccacatacagaggccaatgtagatgcaagagatagagacaaaaacgacacattcaaactaaccagtaaaagtccgggcaaactacaatccgcttcggcaagaaaagtgcacataagccctacaggactaataagggaaggatga

SEQ ID NO: 4929 - RNA, 3108 nt, synthetic construct
  misc_feature 1..3108: note = Cas9 variant
  source 1..3108: mol_type = other RNA
atggaacaattaaattacatattaggactagatataggaatcgcaagcgtcggatgggcagtagtagaaatagatcacaatgaagatcctatccgattaatagatgtaggagtaagaacatttaataaagccgaagtcgcaaaaacaggagaaagtttaagcctaataaggagattggcaagggggtccagaaggttggtacgtcgtaagaaaatgcgactactcacagccaaaagattactaaaaagtgaaggcatactaagcgacttagatttcaataaaggagctatactaaacttgccgaacaattgctgggaactgcgagtaaaaggactcgacaagaaattaagcgataaagaatgggcagcagttctattacatataatcaaacacagaggatacctatcacaaagaaaacatgacagaaaaacggatgataaagaactgggagcattattatccggcgtgagtaaaaaccactcactactagaagagggagaatttcgcacagcagcagaattagcaatcaatgtgttttgcaactcaaaaggacacataagaaatcaatggggagactatagccatacattttccagactagacctccaaaaagaaattaaacaattattcgtaagccaacgtgaattagggaatccctatacatcatcatcattcgaagaaaatattataagccttttaatgaaacaaaaagaagccatatcaggtaacgacatattgaaaatgctaggaaaatgcacatacgagaaaaatgaatataaagcagctaaaaacacatatagcgcagaaagattcgtatggctaacaaaattaaataacttaagaatagtagacgatggagtcgaacgcgcattaaactcaagtgagagaaaattgctaatagacgaaccctataagaaagctaaactcacgtatgcccaagttcgtaaaatactagaattaccagacagcgctgtcttcaaaggagtaagatactttgctgataacgcagagagctcaacattaatggaaatgaaattttggcattcgatacgaaaagcattggaatcgaataacctaaaagacgaatggttagtactaaaaacaaaaccagaattactagacgaaataggaacagggtttagcatatacaaaactgatgatgatataacctcctatctaagcaacaaattagataaaaaggtactagacatactcttagtcgaagtatccttcgataaattcatagaattaagtttaaaatgccttagaaaaataattccactaatggaaaaaggatacagatatgacgaagcctacaaatatatctatggggaagtaaatatcgaatataaccttaatgacataaagaatccggttgtgttaagaagtttttcccaaagtagaaaagtaattaacgcggtcataagattgtacggctcaccagctagaatacacatagaaacggcgagagacattggtaagagtttcaaagaaagaaaagcaatagaaaaacaacaggagaaaaacaggttagaaaaagtccgagcggcggaacacttcaaacaactatttcctaattatgtaggagaacccaaagcaaaagatattctaaaagtacgactttacgaacaacaacagggaaaatgtctctattcaggcaaaatattagacatcaaacgattaatggaacacggttatgtagaaattgaccatgcactccccttttcacgaacatgggatgattctttcaacaacaaagtattagtcttagcaaatgaaaaccaaaataaaggaaacaaaaccccatatgaatggttcaatggcaaagataactcagatagctggaaaagattcttagcattagtaaataactccggattctcggcagtaaagaaacaacatattttaatgaaagaaatagacgaggaaggatttaaacaaagaaacttaaacgacactaggtacataacaagatttctttgtaactgggtagaaaataacatccctcttttaggaaaaggtgtaaaaagagtatttgcaccccaaggcaaaataacagcactactaagatcaaattggggaatcagaaaagtaagagaagacaacgaccgtcatcatgcaattgacgcaatagtagtggcttgcacaactgtatcaatacaacaaagaataacaaactatgttaaaaacagtgaaattaacagaaaaataaaaagacaaaactaccttaaattcccggaaccctggaaattcttcagagaagacataagtatccgagtattttctaataaccctattgaagaactcaaacaacaactaagtgaccgacccgaagctaatcaccaattcgtaacaccactatttgtatcaagagcgccagtgcgaaaaatgacaggacaagggcatgaggacaccataagatccgcaaaaagaatatccgaaggtatcagcgtcttaagagtaccactaactaaattaaacgataagagtctagagcttatggtgaacagagaaagagaaaaagagctatatgatgcgcttaaacaaagactcctcgagttcaaaaacgaccctgaaaaggcttttgctgaacctttttataagaaaggagggcagcaagtaaaaaccgttagaatagaaagagttcagaaaaatggagtattggtaaacaacaacacaggcatagcagataatggcaacatagtaagagtcgatgtctttttaaagaagaagaaatacttcttagtaccaatatattcctggcaagtagcaaaagggatcttacctaataaagctatagtagcacataaaaatgaatgtgactgggccgacatggacgggtcagcccaatttctatttagcttatatacaaacgacctgatcgaagtcgtattaaaagatagcaccatattaggatatttcagtagtatagaccgagccacagcagcaatcataattaaagaaccagatatggaaaaatctaaaggaaaagaaggaatacacagagtaggtgtaaaaacagccaggagctttataaaatacaacgtagacgtcctagggaaaaacatttccagatgtagaaaagccaaaagattaccagtaagatga

SEQ ID NO: 4930 - RNA, 3108 nt, synthetic construct
  misc_feature 1..3108: note = Cas9 variant
  source 1..3108: mol_type = other RNA
atgttacggaagatgcattatagattagcattagatctgggtagtacaagtctgggttgggctatgatccgactaaatgcaggaaacgaaccctgcgcagtaataaaagccggagtacgaatcttcagtaatggaagaaacccaaaggacggaagctcattagcagttacgcgaagagaggccagagctatgagaagaaggagagaccgtttattaaaaagaaaagcaaggatgatacaaactttaatagaatatgggttctttccagcgaaagaagatcagaggaaagcactcgaaattatgaatccatttgcattaagagcaaaaggattaaacgaagcattaacaccagcagaatttgcaagagcactatttcatataaatcaaagaagaggtttcaaaagtaaccgaaaaacagataagaaagataacgactccggagcattaaaaactgctattaataaactaagggaaacattaaaaacagagaactgcaggacagtaggtgaatggcttaacaaacgagacgtagccggactaacagtgagagcaagatatcaccaggataaaacaataaaagaagatggtaaaagtaaaataaacaagtactatgatttatatattgacagagcaatgatagagcatgagttcgatgaattatggaaaaagcaagcggaattaaatccgactctattcaccgaagcagcacgagcagatctaaaagacgtattactccaccagagagctctaaaaccagttaagccaggaaggtgcacatttatgccggacgaagaaagggctcctctagcactaccttcgacgcaaagattcagaatgtaccaagaagtaaacaatttacgtatattaagagatggtttaaaagaagaatcacttacactgaaccaaagagatgatctaatagcagcattagaggaaaacaataaaagaacctttacacaaatcaagaaattactaggactaggtggcgtagttaaatttaactttgaagatcctaaaagagaggaattgaaaggaaacactacaagtgcaatattaggaaaagacgaacattttggatccgtttggtttaaatttgatgaagccaaacaggacgcgatagtaatgcaattatttaaagaagagaacgaagcaaaactactaagatggctacaaaatgaaactggaatagatgagaaaagagctgaaacaatagctaatgtaggcctgccagaaggatacggatcattatgcgctttagcactggcaaggattttacccgaattaagaagagacgtagtaccatactcagacgcagcaaaagcagcaggattccatcacagcgacacaagcaataatcaagaagtccctggattaaccttcccaatagaacttgtagtaacagaaaccggagagataaaaacaaaacatatcttccatgaattaccctattatggagaatacttacaaagacatgtagggtttgggagtggcaagccagaagatagcgctgagaaacgatatggtaaaatagcaaatccaacagtccacataggattaaatcaagttagattggttgtaaacacactaataaaaagatatggacatccaagtgaagttatagtcgaggtagctcgagacttaaaacaaagcaaagatttaagagatgaagaaggaaaacgtcaagcagaaaatcaaaaacgaaataaacgaatacgaacagctatagcaggagtacttcaaacaagtgaagaaagagttagaagggacgatatagagaaaatgatactatgggaagaattatcttttgacccagctgatagaagatgcccatattcaggcgttcaaatatctgcagcaatgttgctatctgacgaagtagaaatagagcacatcttaccgttctcacaaacattagacgacagcctaaataacaaaacagttgcactcaggcaggcaaatagagtaaaaggaaaccgaactccatgggaagcattcggagcccagagtacggccggcttcgactatgccacaatactggcacgagcagaacatatgccaaaaggaaagagataccgattcgcagaagatggctaccaacgttggctaaaagacgacgcaggatttctacctcgtgcgctaaacgatactagacatatgagtaaagtcgcaagagaatacatgagcctaatatgccctaataccagagttataccaggacgaatgacggcaatgctaagaggaaaatttggattgaacgacgtattgggtctaaatggagagaaaaatcgaaatgatcatcgacatcacgcagtagacgcttgtgtcatagccgtaaccgatcaaggtttactacaaagattcgccaaagctagtgcgagcgccagggaacagcaactaaacagattagtcgaaaatatgccactcccctgggaatcctatagagaacatgtagaaagagcaatagacgcaatatgggtaagtcataaaccagatcatagtcatgaaggcgccatgcataacgacacagcatatggactattaggagatggaaaagtatccatacataaaatggtagaaggaaaaagagaacgaatcgaagaatcattaaaagttatcgcttttacaaacgcaaaggccaatgatagacatggactcctagacaacggagaaccaagaccatataaaggatataagggagatagtaactactgcattgaaattataagaaatgaaaagggaaaatgggaaggggaggtaatcagtacatttgacgcataccaattagtacgagagcatggcgttgcaagattgagacatccgactttgtcagtaagcggaaaacctttagtcatgagactaatgaaagacgaaacaatacgcatggtaaccaacgaaaaaccgataactgcaagggtctgctgggttagaagtgatactcgaatagcattcgcttcaacttcggaagccaatgtagatgctcgagacagagacaaaaatgattcattctcatatatagtaaaaacagcaagtgtcctacaaaaattacaagcaagaagaatatcaataagtccaacaggagagctaagagaccccggattcaaagaatga

SEQ ID NO: 4931 - RNA, 3108 nt, synthetic construct
  misc_feature 1..3108: note = Cas9 variant
  source 1..3108: mol_type = other RNA
atggaacaactaaactacatattaggattagacataggaattgcttcagtcggatgggcggtcgtagaaatagaccataacgaagatccaataaggttaattgacgtaggagtacgcacattcaacaaagctgaagttgcaaaaacaggagaaagcctatcactaataagaaggctagctcgaggaagcaggaggctagtaagaagaaagaaaatgcggctgcttaccgctaaaagattactaaaaagcgagggaatcctgtcagacttggacttcaacaaaggagcaattcttaacttaccaaataactgctgggaactcagagtaaaaggcctagacaaaaagctgagtgacaaggaatgggccgcagtgttgctacatataataaaacatcgtggttatctaagtcaaagaaaacatgatagaaaaacggatgataaggaactaggtgctctactaagcggcgtatctaaaaaccattcactactagaagagggtgaatttagaacagcagccgaactagctataaacgtattttgcaattccaaaggtcacatcagaaaccaatggggagattactcacacactttcagcaggctagatctacaaaaagaaataaaacaattgtttgtaagccaacgagaactagggaacccatacacatcctcgagttttgaagaaaatattatatctctattgatgaaacagaaagaagcaatttcaggaaacgatattctaaaaatgttaggaaagtgcacatatgagaaaaacgaatacaaagccgctaaaaatacctattctgctgaaagattcgtctggctgacaaaattaaataacttacgaatcgtcgacgacggcgtcgaaagagctttaaacagtagtgaacgcaagctattaatagatgaaccatacaagaaagcaaaacttacatatgcacaagtgcgaaagatattagaattaccagacagtgcagtattcaagggagttagatactttgccgacaacgcggaaagctcaacattgatggaaatgaaattctggcatagcataagaaaagcactagaatcgaacaatctaaaagacgaatggctagtattaaaaacaaaacctgaactgcttgatgaaataggaacaggattttccatatataaaactgacgacgacataactagctatttaagtaataaattagacaagaaagtcttagatatattactcgttgaagtcagttttgacaaatttatagaattatctctaaaatgccttagaaaaattataccattaatggaaaaaggatatagatacgacgaagcatacaaatacatatatggagaagtaaatatcgaatataatctcaatgatatcaaaaacccagtagtattacgatcatttagtcaatcaagaaaagtaataaacgccgtaatcagactatacggctcaccagcaagaatacacatagaaaccgcaagagacataggcaagagttttaaagagagaaaagccatagaaaagcaacaagaaaagaaccgattagaaaaagttcgagcagccgagcatttcaaacaactattccctaactacgtaggtgaaccaaaagccaaagacatattaaaagtcagattatacgaacaacaacaaggaaagtgcttatacagtggaaaaatcctagacatcaaaagattgatggaacacggatacgtagaaattgaccatgccctcccattctcgcgaacttgggatgactcattcaacaacaaagtattagtcttagccaatgaaaaccagaacaaaggaaacaaaaccccgtatgaatggtttaacggtaaagacaactcagatagctggaaaagatttctcgcattagtaaataactcgggattctcagcagtaaagaaacaacatatactaatgaaagaaattgacgaagaaggtttcaaacaaagaaacttaaacgatacaagatacatcacaagattcctctgtaactgggtagaaaacaatatacccctattaggtaaaggagtaaaaagagtatttgcaccacaaggaaaaataaccgctttactgcgcagtaattggggcataagaaaagtaagagaagacaatgacagacaccatgctatcgatgcaatagttgtagcatgcactactgtatctattcaacagagaataacaaactacgttaaaaacagtgaaataaacagaaagataaaaagacaaaactatttaaaatttccagaaccgtggaagttctttagggaagacataagcataagagtcttctcaaataacccaatagaggaacttaaacaacaactatcagatcggccagaagcaaatcaccaatttgtaactccattatttgtaagcagagcgccagtaaggaaaatgacaggccaaggacacgaagatacaataagaagcgcaaaaagaataagcgaaggaatatcagtattaagagtccccctcacaaaattaaacgataaatcattggaactaatggtgaatagagaaagggagaaagaactttatgacgcattaaaacaaaggttactagagttcaaaaacgaccccgaaaaagcatttgcagaaccattctataagaaaggtggccaacaggtaaaaacagtcagaattgaacgagtccagaaaaatggagttttggtaaacaataacacaggcatagctgataacggaaacatagtaagagtagacgtatttttaaagaaaaagaaatattttctcgtaccaatatactcgtggcaagtagccaaaggtatacttcctaataaagcgatagtagcacacaaaaacgaatgcgattgggcagacatggacggaagcgcgcaattcctattttcactgtacaccaacgatttaatagaagttgtgctgaaagactctacaatcctagggtactttagttcaattgacagagcaacagctgccttgataataaaagaaccagacatggagaaaagcaaaggcaaagaaggaatacaccgagttggagtaaaaacagcaagatcttttatcaaatacaatgtagatgttctaggtaaaaacattagtagatgcagaaaagcaaaaagacttcccgtcaggtga

SEQ ID NO: 4932 - RNA, 3111 nt, synthetic construct
  misc_feature 1..3111: note = Cas9 variant
  source 1..3111: mol_type = other RNA
atgagaatattcggtttcgacatcggcatcacatcaataggatgggcatatgttgaaagcaatgaactcaaggattgtggcgtaagaatatttaccaaagcagaaaaccctaaaaacggaaaaagcctagcactcccaaggcgagaagcacgtggtgcacgaaggagacttgcacgcagaaaggcaagacttaacgctataaaacgattactatgcaaagagttcggcttaaacgtatcagactactttgcaaacgatggtgaattaccaaaagcatatgaaacaacaaaagacactaaatcaccatatgaactaagatccctggcattggaacaaaaattagaacccaaagaactggctagagtaatattacacatagcaaagcatcgaggctatggaaataaacacgcaaaaacaggatcagataaagatagtggcaaagtattatccgcaatcaaagtaaatgaaactgccatgaaagacaaataccaaagtgtaggcgaatatctatacaaggagttctaccagaaactaaggctcgaaagcgaaaagaaaggaaacaacataacaaaagagttcaaaaacgtcagaaacaaaggagaaaattacgaacattgtgtcgcgcaagaacaagtacgagctgaattagaactaattttcgcaaaacaaaaagattttggagctactttctcagaaaatttcgaatcacagattatagaaaccgctttctatcaacgagacttaaaaagtttcgaagataaagtaggtaaatgcgtattctatgaaaacgaaaatagagcaccaaaagactcactaagtgccatggaatttgtagctttaactagaataataaataccttgaaaaatttggaagagaaaagtaaaaacctaggaatcggagaagtctatggaaaagacaaaatacaggaaatacttaaaatagtcctagataaaggcgaaatgagctacaagaaactaagagaaatattacacctagatgaacacatactattcgcaaaagacagcaaactggactacacccaaggtgtacaagaagcagaaaaagcaaaattcatcgaactaaagaatctaaaagcatttaagaaagccatgggaggagactttagcaacttcgcgagagaagaattagacaaaatagcaacagatataacactcgttaaaagcaaagaaaatttagccaagaaattacaaaattacagtgcactttcaaaagaacaagttgaagccctttcgaacctaagttttgcgaaacatattgacctaagtttaaaagcactagaacaaatcctaccgttcatgagaggagacaaaacaggtaaatgtctacgatacgatgaagcagtcaagaaagcagaattacaagaacacagaaaacataaacaaaaaggagagttcctaattccgctaaaagactacgaaccatacttagcaaatccagtagtggcgagagcactttcagaatatcgaaaagtactaaacgcgctattaagaaaatacggaaaagtgcacaagatacatctagagttcacaagagaagcaaaattatctgcaaaagaacgacaaaaatatgaaaaagaacaaaaggaacattttgaagcaaatcaaagagcaatccaacagtgtgaaatactaggccttccaattaatggaacaaatatattaaagatgaaactatggctagaacaaggggaatgttgcgcatattccggagagaaaataacaagagaacatcttctagatagcaatgcgttgcaagtagaccatatttacccatatagcagatcatttgacgattcttatatgaataaagtactggtcttcgcaaaagaaaatcaagacaaaggaaataaaacaccattcgaagcatttgggggcgataaggaaaaatgggatcgtatattatcattaagcgcgaaactacccaagcaaaaacaacgtagaatctcaaatacaaattttaaagataaagaaggaggattcttagcaagaaatctaaacgatactggatatatagcgaaattagcatcacagtggaccaaagactgcctagagttcgaagacctaagagaaaatgaagtaactatcgcaggagaaaagggaagctcagttcatatagaagtcgtaagtggccaattaactagcatgttgagacactactggggactaggaaacaaagatcgtaataaccacttacaccatgctgtcgacgcagtcatattagcttatacaaacaacgcaatgattaaagcctttgctaacttcagaaagaatcaagaagaaaataaaaagaaattctatgcaaaacaaatagcagaatcagaatataaagcaaagaaagccttcttcgaaccctgcaaaaattttagacaaagagtcgaagagaaaatcaaagaaattttcgtatctaaacctccgagaaaaagggtacgaggagccttacatcaagaaacattttacccatttgaaaagttatgcaatgacaaagaatactcagaaaaactaaaaatggattacgggggagaaaaaggtatgcaaaaggcaatagcattagggaagatacgccaaataggaacgaaaattgtaagtaatggagccatggttagagtagacatctttaaagataagaaaggtaagttctatgcggtcccaatatatacaatggattttgcactaggcattctaccaaataaagcagttgctattggaaaagataaagatggagtaataaaagactggatagaaatggatagtaattacgacttctgctttagtctatttaaagatgatttaattttagtccaaaagaaagaaatggaaagagctgaactatgttactttgtttcattcggtagtacaaacgcacaaataaacgtagaaaaacacaataataaattcgaaggattaagtgagaacgagaaaatattatactccaatgcgacccaaaaagaagtagcaggaaaatcaataggtatacaaaatttaaaaacatttgaaaaataccaagtcagccccttaggggaagtacagaaagcagagttcgaaccacaccaagaaatcaaactaaaatcaagtccgaaacgaaaggactga

SEQ ID NO: 4933 - RNA, 3111 nt, synthetic construct
  misc_feature 1..3111: note = Cas9 variant
  source 1..3111: mol_type = other RNA
atgttgcacaaaatgcattatagacttgcacttgatctcggatcaacatcactaggatgggcaatgataagattagacgccgataatcaaccgtgcgcagttataaaggctggagtaagaatatttagtaatggcagaaatccaaaagatggcagctcgttagcagtcactagaagagaagctagggcaatgaggagacgaagagaccgtcttctcaaaagaaaagcaaggatgatgaggacactaattgaatacggatttttcccggcagaagcagcgcaaagaaaggcattagaaacaattaatccatttgcattacgggcaaaaggactagacgaagctctaacaccagcagagttcggacgagcattatttcatataaaccaaagaagagggtttaaaagtaatagaaaaacagacaagaaagataatgattcaggtgcgctaaaaactgcaattggaaaagtgagagcaacaatagaagcagaaggatgccgcacagtaggagagtggttacacaaaagagacgtagcaggacttactgtaagagcaagatatcatcaagataaagtaattaaagaggacggaaaaactaaaattgataaatattatgatttatatatagaccgagcgatgatagaacaagaatttgatgagttatggaagaaacaagcagagcttaaccccgcattattcacagaggcagcgagagccgacttaaaagatgtacttttacaccaaaggccgttaaagccggtaaaatccggaagatgtacattcatgccggacgaagaaagagcgccactggcactaccttcaacgcaaagattccgaatgtatcaagaagttaacaatttaagaatactcagagacggattaaaggaagaaccattgactttaaaacaaagagatgatttaattgctgctttagagaaaaattccaaacacagctttacacaaattaaaacactactaggagtcggtggagcagtacaatttaattttgaagatctaaaacgacaagaacttaaaggaaacactaccagtgcaatattatcgaacgataaacatttcggaaaagcctggttcacttttgacgaagctaaacaagatgctatcgtacttcaattggttaaagaagaaaatgaagctaaattagttagatggcttcaagatgaaacaggtatagatgaaaaacgcgcggaagcaattgccaatgttgggttaccggaaggatacggcagtttatgcgcaaaagccttagcacgtatcttacccgaactaagaagggatgtaatgacatatgataaagcagtacaagcagcgggtttcgaacatcactcaagacttggatcaaacactgaaatcccaggattaacattcaaaatagaatctatagatcaagacagcggagaagtaaaacaattccatatacataaagtgctaccatattatggagaatacctgcaaagacatgtaggtttcggtagtggcgaaccagaagacccagcagagaaaagatacggaaaaatagcaaacccaacagtccatattggactaaatcaaattaggttagtagtaaatgcattacttaaacgatatggtcatccaagcgaggtgatagtagaactcgcaagagatctaaaacaaagtaaagatcaaagagacgaggaaagtaagagacaagcagaaaatcaaaaacgaaataaaaggttaagagatgcaatcgccggtacattaaaaatttcagaagaaagagtaagaagagatgatatacagaaaatgatattgtgggaagaattatcttttgatccggccgacagaagatgcccttattcaggagcccagataagtgccacaatgctactaagcgacgaagttgaagtagaacacatactacctttcagccaaacactggatgattcattaaacaacaagacagtcgcgttaaggcaagcaaatagaataaaaggcaaccgaacaccatgggatgcttttggggcacaagcagtcgctggatttgattacgagtctatacttgtaagagctgaaggcatgccaaaagcaaaaaggtatagattcgcagaaaacggttaccaacggtggttaaaagacgatgcatcgtttttagcacgcgcattgaatgatactagacacatgtccaaagtagcattcgaatacctaaaacttatatgccccaatacaagagtaataccaggacgaatgacagcaatgctgcgagcaaaatttgggttaaatgatgtactaggactaaatggagagaaaaatagaaatgatcacaggcaccatgccgtagatgcatgtgtaatagcagttacagatcaaggcctattacaaaggttcgctaaagcatcagcatcagctagagaacaacaattaaatagattagttgaaaacatgcctctaccgtggggaagctaccgagaacacgtacaaagggctataaatgccatatggatttcccataaaccagatcactctcatgaaggtgcaatgcataatgatacagcatatggattacgaggagacggaaaggttagctttcataaaatggttgaaggagtacgtactcatagcgaagataacctaaaagtaatcgaaatatcaaatgcaaaagcaactgaccgacatgggctacttccaaatggtgaaccacgaccctataaaggttacaaaggtgacagtaactactgtatagagatcgttagaaatgagaaaggtaaatgggaaggcgaggttatatcaacattcgaagcataccagctagtccgagaacacggtatagctcgattacgccactcgacattaagcgtaagcggtaaactattggtaatgagactaatgatagacgacgtagtacgattaataatagatgaacaaactagaacaatgagaatcgctacacttagtggaaatgggcaaatattcatggcagacacatcagaggcgaatgtagatgcaaggaatagaagcaaagaagaaacatttgcttacgtatcaaaaatggccgggtcattacaaaaagccaacgcgcgacgaataaacataagtccaataggagaactccgagacccaggctttaaagaatga

SEQ ID NO: 4934 - RNA, 3114 nt, synthetic construct
  misc_feature 1..3114: note = Cas9 variant
  source 1..3114: mol_type = other RNA
atggaaagaatttttggttttgacattggaactacaagtattgggttttccgtcattgattacagttcgacacagagcgcaggcaatatacaaagattaggtgtccgaatttttccggaggcgagagatccagatggaacccctctgaaccaacaacgacgccagaaaagaatgatgagaagacaattaagaagaagaaggatacgcagaaaagccttgaacgaaaccttacatgaagccggatttttacctgcttatggctcagcagactggcctgtagtgatggcggatgaaccatatgagttaaggagacggggactagaagaaggattaagcgcctatgagttcggtagagcaatttatcacctcgcacaacaccgacatttcaaaggaagagaattagaagaatcagatactccagaccctgacgtagatgatgaaaaagaagcagctaatgaaagggctgccacacttaaagcattaaagaatgaacagactacactaggagcttggttagcgcgaagaccgccatcagacaggaaacgaggaatacatgcccacagaaacgtagtagcagaagagttcgaaagattatgggaagtgcaaagcaaattccatccagcattaaaatctgaagagatgagagcaagaataagcgatacaatatttgcacaaagacccgtcttctggcgtaaaaataccctaggagaatgtagatttatgccaggtgaaccattgtgcccaaaaggaagttggctatcccaacaaagaagaatgctcgaaaaattaaataatttagcaattgccggtgggaacgcaagaccattggacgcagaagaaagagacgcgatattgtctaaattacaacagcaggcttcaatgtcatggccaggagtaagatcagcactcaaagcactatataaacaaagaggtgaaccgggagcagagaaaagtttaaaattcaatttagaactcggtggagaatccaaattgctagggaatgctttagaagcgaaattagcagatatgttcggaccagattggccagctcacccaagaaaacaagaaataagacatgcagtacacgaacgcttatgggcagctgactacggcgaaacaccagacaagaaaagagtaataatcttatctgaaaaagatagaaaagctcatagagaagcagcagcaaattccttcgtcgccgatttcggaataacaggagaacaagcagcgcaattgcaagcattaaaactaccgacaggatgggaaccgtattcaattcccgcgctaaatctcttcctagcagaattagaaaaaggcgaaagattcggagcacttgtgaatggaccagactgggaaggatggcgaagaacaaattttccacatagaaatcaaccgacaggggaaattttagataaacttccttcgccagcgtctaaagaagaaagagaaaggatatcacaattgaggaaccctacagttgtaagaacacaaaatgaactcagaaaagtagtcaacaatctaattggtctctatggcaaaccagatagaatacgaattgaagtaggaagagacgttggaaaatcaaaaagagaaagagaagaaatacaaagtggaataagaagaaatgaaaaacaaagaaagaaggcaactgaagacctaatcaaaaacggcatagctaacccatcgcgagacgatgttgaaaaatggatattatggaaagaaggacaagaaagatgtccatataccggcgaccaaataggttttaacgcactatttagagaaggaagatatgaagttgaacatatatggcccagaagccgatcatttgacaactcaccacgaaacaaaacactttgtaggaaagacgtaaatatagaaaaaggaaacagaatgcctttcgaagcgtttggccatgatgaagaccgatggtcagcaatacagattagactgcaaggaatggtatcagcaaaaggcggtacaggaatgagtcctggaaaagtaaagagatttctagcaaagaccatgccagaagattttgcagcaagacaactaaacgatacaagatacgctgcaaaacaaatattagcacaattaaaaagactatggcctgatatgggaccagaagcaccagtaaaggtggaagcagtaacaggtcaggtaacagcacagttaagaaaattgtggacattaaacaacatacttgcagatgatggagagaagactagagcagaccatagacatcatgcaattgatgcattaacagtggcttgtacacatccaggtatgactaacaaactttcacgatattggcaactaagagacgatccacgtgcagagaaaccagctctaactccaccctgggacacaattagagccgatgcagaaaaagctgttagtgaaatagtagtttcacaccgagtaagaaagaaggtatcaggacctttacataaagaaacaacatatggtgacacgggtactgatatcaagacaaaatcaggtacatacagacaatttgtgactcgcaaaaagatagaaagtttgagtaaaggagaacttgatgaaataagagatccaaggatcaaagaaatagttgcagcacacgtagcgggaagaggcggggaccccaagaaagcatttccaccatatccctgtgtaagtccaggagggccagaaattaggaaagtaagattaacatcaaaacaacaactaaacctgatggctcagacagggaatggatatgcagacctaggatcaaatcatcatattgcaatatataggttacctgacgggaaagccgattttgaaatagtcagcttatttgatgcctctcgaagattagcacaaagaaatcctattgtacagaggacaagagctgacggcgcttcatttgtgatgtcactagcagctggggaagctatcatgattcctgaaggatcaaagaaaggtatctggatagtacaaggcgtatgggcatcaggacaagttgtattagaacgagatacagacgctgatcatagcacgaccaccagaccaatgcctaatcctattctcaaagacgatgctaagaaagtaagcatagacccaatcggtagagtaagaccatcaaacgattga

SEQ ID NO: 4935 - RNA, 3117 nt, synthetic construct
  misc_feature 1..3117: note = Cas9 variant
  source 1..3117: mol_type = other RNA
atggcaaaacaagtcagatacagattatcactggaccttggaagtacaagtctaggatgggctatattcaggctagacgctgatgcacatccaacagctataataaaagctggtgtaagaatattttcggacggacgaaatgcaaaagatggttcttcactagctgtaacgaggcgagctgcaagatcaatgagaagacgacgagacagattacttcgcagaaaaacccgaatgctagatgcattgctggaatatggatttttcccacaagacgcagcacaaagaaaagcactagaaaggctaaacccatatgctctaagggccgaaggattagcaagaccattaacaccaggagagttcgcaagagctattttccacctaaatcaaagaaggggttttaaatcaaatagaaaaacagataaaaacgataacgactcaggagccttaaaaacagctacaagtcaattaagacaagatatccaagcgtcaggatgccgcactgtaggggaatggctctggactcaacgtttgcaaaagaaaccagaaggagtcccacatcaaggtgtaagagcaagatatagagagactccacatataaatagcgaaggtaagaaaagaatagaaaagaaatatgatttatatatcgataggtcgatgatagaagctgaatttgacgcgttatggagtgcacaagctacatttaatcccgttgtatttcatgctacagcacacgaaaaattaaaagatatacttttatatcagcgaccgcttagaccagtcaaacctggaagatgcacattattaccagaagaagaacgagcgcctctggccttaccatccacacaaagatttagaatttatcaagaattaaataacttaagactgttagttgatcaattaaacgaacagcctctaacgcttgcgcaaagagacacaatagcaactctcatggaggggagagcaaaaataagtttcgatcaaataagaaaagcattaaaactaggatcaatgacaaaattcaatttagaagacgacaaaaggaacgaattaaagggaaatgcaactggatctcaattagcaaagaaagaatttttcggcccagcgtggcaccaatttgatgaggctttacaagacgatatagtatggcatttactaagtgaagaaaacgaaagcgctctcataagttggttacaagatagaaccggaatagatgcagcgactgcacaagcagtatcgaacgcatccttacctgaaggctatggtagtttatcgagaaaagcactagaagttatattacccagattacggtctgaagtaataacgtatgacaaagcagtgcaagcagcaggatttagccatcattcacaattgggctttgagtacgatcctgatgatgtagaagattggatagatcatgcaacgggagaagtaaaaccaatatttaaaagattaccttattatggaaaagcactacaacgccatgtagcatttggaagcggtaaacccgaagatagccaggaaaaacgttatggtaaaattgctaatccaacggttcacattggcttaaatcaagtaagagtagttgctaatgcattaattgcaagatatggcagacctaccgagatcataattgaattggcaagagacttaaaacaatcaagagaacaaagacagcaagaccaaagaagacaagcagataatcagaaaagaaatgcacgtatacgaaattcaatagcacaggctttaggaatcgctgaggcccgagtaagacgcgaagacatccaaaaatggattctatgggaggaactagatccaggcgacgctatgcatagatgctgtccatattctggagttccaatatctgcatctatgttattatcagaacaagtagagattgagcacatcttaccattctctatgactctagacgattcacttaataatagaacagtatcattaagacaagctaataggattaaacgcaatagaagtccatgggatgccagagaagacttcgaagcccaaggttggcattatgatgggatcttacaaagagcgggacttatgccagtacaaaagaggtacagattcgcagcagatggatatcaacgatggttaagggacgaccaagattttctcgcgagggcactaaatgacacaagatacctatcaagaatagccgcggagtacttaagacttgtttgtccgcaaggaacaagggtcataccagggcaattaaccgcactacttcgaagaagatttgggctaaatgatatactaggattagagggagagaaaaacagaaatgatcacagacatcacgcagtagacgcatgcgttataggaattaccgatcatggattgatgcaaagattcgcaagagccagtgcacaagcaagagaacaaggtctgacaaggctagcagaagaaatgccactgccctggcctacatatagagaccatgtagacagggcggtgagcttaatatgggtaagtcataaaccagaccatggacacgaaggagcaatgatggaagaaacagcttatgggctaatgaaagatggaaccataagacaacgccataaagctgatggaaccaaaggcagggaagtagcaaacgttataaggattgcggaacccgctcaaccgactaggcacggagtggatgaccaaggtagacctcttccatataagggatatataggcggttcaaattattgcattgaaataaccagaggcgcacaaggtaaatgggagggaaccgttatctcaacatcggatgcttatggaatagtgcgagcaagaggaattgcaggattacgtaatacatcgcaaggacaaaatggacatccattagtaatgagattggtaataggcgatagtttacgattacgaatcaacgatgcactacaaaccatgcgagtaacaaaaataagtggaaatggtcaagtattcatggccggggttcatgaagcaaatgtagacgcaagaaatagagataaatctcaagccttcgccctagtaagtaaaatggcaggctcactgcaagcagcacaagcccgacaagcaacaatctctccaataggggaaataagagatccaggatttcccggatga

SEQ ID NO: 4936 - RNA, 3120 nt, synthetic construct
  misc_feature 1..3120: note = Cas9 variant
  source 1..3120: mol_type = other RNA
atgaagaaaagaatactcggattggacataggaatagcatcggtgggatgggcacttatagaatttgacgacgagttccaagacaacaaaaagaaaggaacgattataaaaagtggcgttagaatatttacgagagcagaaacgccaaaagaaagagaaccacttgccaaaccaagaagagaagcacgatctcaaagacgaagaataagctgcagagtagaacgactaaatttcgtacgagaattattcgtgaaaaacggcttagttgcaaaagaatctgtgaataaaaataatccaaacaacatttacatcacgctaaatcaaattaaaacaccttggcaactaagaatggaagctctcgacaggaaattaacaaatgaagagttcgccgtagtactaacccatctagcgaaacataggggatacaagtcactaagaaaaacggactcaaaagacaacaaaacaggggaaatgctaaaagcaatcaaccaaaataaagaaagattagataacagcgactacagaacactaggagaaatgttttgtaagcatgaaagctacaaagaacataaacggaataaagatggagaatatattaacagcgtcactagagaattaattgaagaagaagcagaaaagatatttgccaaacaaagaaaggaagggaataacttcgcagatgtagacatcgaacgagaatatcttaaaatagcattctcacaaaaaccaacaggaagtataaacaaaatggtaggcttttgcacattcgaaaatggtgagaaaagagcgcctcgtgattcttactccgcggaattatttaaagtccttaataccataaataataccacaattactgacatgaaaacaggggaaacaagaaatttcacaggagcggaaattaaaaagataatagaaataataaaagacaccaaaggaataacatacgtcaaaatcaagaaagaactgaaattaggaagttctcaattcagtggagtagattatagagaaaatgcaaaatccaaaggagaaggtgaaatattcgtttcaatgaaaacataccatgaaataaaaagcaaaatagaaaaacttagcaaagaaaaatggaataaattaaaagaaaatactgaattactagatagtatagtaaatataatagcgaatttcaaagacgatgaatcaataaagaaagagttccaaaaattaaaaattgacgaagacataatagacgtattattaaattttgaatttaagaaattcataaacctttcattcaaagcacttaggaaaataataccgttccaatttcaaggccagaaatacataacagcttccatgtccgtaggctatagcctgaaacaagaagggatcaaaaataaattcctaagagtgccaagtcaagaagaaaacgtaaacgttccagtagtagccagagcattcgcacaaacacgaaaagtaataaatgctgtaattagagaatatggtcaattcgaccaaattaatatagaactagcaacagatctcaaaaatagtaaatttgatagaagcaaaatagaaaaagggcaaaaagagttccaaagccaaaaagataaagtattccaagaagttcaagacctaacaggagaaattataccatcatcatcactcctcctaaaatatagactatggcgagaacaagacgaaagatgtatctacagcggacggaaaatatcaaggaaagatttactagacacaggctttttagatatagaccacataataccctactcaaaaagtatggacgatggattcaataacaaagtattatgtctggcagaagaaaaccgaaataagaaaaacgacataccattcaactattaccagcgaatcggaagagactggaattttctaatctcaataatagcctcaatgaaaaatatgaaatacgtgaaaaagaaaagattactaaaacaagaactaagtgatattgaaatagaatcctttatagaaagaaacataaacgacaccagatatgcaacacgatatatcaaaaatttcctagaaaacaacctagagttcaaagaaaatgagttcataaaagctaaagtacaagcaagacatggaggactaacaagcgttctaagatacaattggggcataagcaaaaacagagaagaaagctacttgcaccacgcaaaagacgcaataacggttgcttgcagtactcaaggaatggtacaatatatatcaaacataagccaaaaatatgaaaatggaaaatacaaaatgaaacaaataaaagaacgaacagaaaatagaatcccaaaaccttgggattcatttaaagacgacgtagaaagatctataaacgacatattcgtatcattcgcacccagacataaagtaacgggaagcgcccataaagaaactatatatagtaagaaacatctagaaaaaggatatgtaactataaagaaatcgctagataaaattaaactttctgacctcaaaaacataccctgtgatgaaaactgcgatataatacgagtactaaaagaacgactagaaaaattcaatgacgacagtctaaaagcattcgcagatccagtacatatgccaacaaaatgctcaaataagaaaggaccaataataagatcggtaaaaataaaagaaaacaacaaaacaggaatcgaagtacgcaaagggttagtagaaagaggtgatatggtacgagtagacgtcttcattaaagataagaaatattacttagttccaatatatgtatcagattttaaaaacaaagatcttccaaacaaagccatagtatcatcaaaatccgaaaacgaatggataatgattgacaaaacgtacagcttcaaatttagcttattcaaagacgacctaataaaaattaaaaacaagaaaggcgaaatattcggatacttaggaggggtccaccgtctcaccggtgggataaatataaaaagctgctataaaccaaaagaaaaagacggtaacataggaagcaaatgtctattagactttagaaaattccaagtagggatactaggagattacaatgaagtgaaacacgagaaaaggatgccagcatatatcaatactaagaaagacaaagaacactga

SEQ ID NO: 4937 - RNA, 3123 nt, synthetic construct
  misc_feature 1..3123: note = Cas9 variant
  source 1..3123: mol_type = other RNA
atggatcgacgggatgcaagggctatgagaaggagaagggatcgatttcaacaaagacaaagggctctgttaaaatatctggttgcagacggattatttcctgaagatgaaggtgagcgtaaagcactagcagctttagacccctatgcactaagagcaagagcattagatgaagcactaagcctccatgaattagggagggcgttatttcatttgaaccaaagaagagggtttaaatctaaccgaaaagccgataggaaggcggacgatgacgcaggaaaaatagctataggcgtagatagggcaagagaggcaatggcggaaaacggagccaggacctatggcgaatggttgcataggaggagagcgagcgctactgatgcaaatgctattcctcctgtaagaacaagattaagacctgaaagtggcgaagatgcaaaaggagatggatatgatttctatccaggtagagatctactagaagaggaatttgcagcgatatgggaagcccaagcagcgcatcacccagacgtacttacagatgatgtatatgaaagattatttgaaatagtattttatcagagacctttaaaagcaccacaaattgggatgtgtacacttatagcaggcgatagaagactcccaaaggcacacccactatttcagagacggcgtctgttagaagaactgaatgctctaatgattgtacgacctggagaggtagcacaaagattaacccgtgaggagagagatactctattcttaaaattaaaagatagaaacaaagtatcatttgagagtttacgaaaaacactaaagctagaccccgatgcaagatttaacaaagaatcagaaaatagaacagaattgaaaggagatgaagtagcagccgctatgggcagtaaaacaagatttgggaatagatgggtacatttatcaatcgaagaacaatgggcagtgatagagcgattaggagatgtagaatccgatgcagaagatgcggcgtttagggcatggttagctgaacgatacgaattaacgccggagcaaactagagcggtaacaaatgcacctctacctcagggttatggaagatttggagaaacagcaacaagaaaactaatagatgctttgagagatggggagaaagacggcagagtactggtatatagtgaagcggtgacagcagcaggattaggacatcattccgacagaagaaccggtgaagtatttgaagatgaagaaggtagacctcaactgccatactatggggtggcactagaaagacacattatgccaggcactggtgacccaagcgattcagacgaaatgcgagtaggtagattaacaaatccaacggtacatatcggtttgaatcaactgagacgaatagtaaatagattaatcagagcttacggacccccagcagaaattgcaatagaattagctcgtgaactaaagttaacagatgaggacaagaaaagaataaacaaagaaaataacagtaacagactagacgcagagagaagaagtgaaaaattattggcaataggcaaacctgacacaggagcgaatagagccttactaaaattatgggaagaacttaatccagctaatgtcctagatcgaagatgtatatattctggggttcaaatatccatcgatatgctattttcagcagcagtagaagtcgatcacatactaccattcaccgctacattagatgactctaatggcaataaaatagtgtgtactagggaggctaacagggagaaacgaaaaaggagcccatatgaggcttggggacatagtgcaaggtgggaagagatagcggcaagagctgcacaattgcctaggaacaagagatggcggtttgaaccagacgcgatggaaaaattcaaagacgatggaggatttcaagcacgacacttaatcgacacacaatatcttgcaagattaagtagagaatatttagccacactatatcctgataaaggagaaggaagcggacacatatgggtatctccgggccgcttaactgaaatggtgagaagaaagttaggacttaatgatctactccccgatcataactttggtggaggcgctgatcaagctaaaaatcgcttagatcacagacaccacgccatagacgcagtagtagtagcaatagtagatagaggcatgttaaacaggatagcaagagcatcgggacaggaaggagcagagggaagagaaagaataataattccagaaccttgggaagggtttagagatgacctaagaacagcagttaacgctataacagtctcacatagaacagatcatggaacagcaagtaaagcgggactacccaaaggaaaagatgcaacagcaggacgcttacataatgacactgcatatggatttacaggagaatcagacgctaaaggaaattctatcgttgttagaagagtaccattaagcagctttaaaaagctagccgacatagatagagtccgagacccagagcttaaagcagcattatatcaacatttagacggtcttgaaggtaaagcattcgagaaagcaataggtgagtttggatcacgtgaatggcatccttacggtggtgtcagaagagtgagagttacagaaccactatcagtaatacctatacgagacagaaatggacacatatacaaaggttataaaggagacagtaattacaggtatgacgtttgggaattacctggcggcaaatgggtaaatgaagttgtcagtatgtttgacgcacatcaaccaggatggcaatcagctatcagagcggccaatcccacagcaagaaaagtgctgagtctacatagagacgatgtactagcgatcgaaagaaatggagcagaacgagaattagtaagagtagtcaaattcagtgaaaaacaatttgctgtagctccgcctaatgagggaggggcattaaaagctagggacgcagacaaaggtgacccatttaagtattcatatccaagcccaaatacattgaaagcattacgtgccagacaagtcagaatcgatgaattgggacgagttctagatcctggattcccggcaagaactaaacagcgcaaaactcgaaaaccaaactga

SEQ ID NO: 4938 - RNA, 3132 nt, synthetic construct
  misc_feature 1..3132: note = Cas9 variant
  source 1..3132: mol_type = other RNA
atgcaaagagacaacccgctcgtctatagattagccttagatcttggatcgacaagcctaggatgggcggtattccgattagatgcggaaggatcacctttggcaataataaaagcaggagcaagaatattcagtgatggacgaaatcctaaagatggttcaagtttagcagttacacgcagagcagcaagagcaatgagaagaagacgagatagattactaaagcgtaaggcacgaatgttgggagcactcgaacgtcatggatttttcccacaagacgaatcagcacgaaaagtcttagaaacacttaacccgttcctattaagagctcaaggtctagaagtagctttaaaaccagaagagtttgggagagcattatttcatctcaaccaaagaagaggtttccaaagtaataggaaaacagacaggaaagattcggattcaggtgcactaaaacaggcaataggaacattaagagcgcaaatgcatgaatcaggatgtagaactgtaggggaatggttctggaaagttaggatggaacataaaccagaaggagtcaaaggacaaggagttagggctagatatagggagacaccattcacgacagatgaagggaagaaacgcatagataaaagatatgacttatacgttgaccgagcaatggtagcacaagaatttgatgcactatgggctgctcaagctgcattcaatccagcactattcaacgaagcagccagggctgaactcagggacatactacttcatcagagaaaattaagacccgtgcaacctggaaggtgcaccttagtcccagaagaaccaagagcgttattggcacttagtagtacgcaaagatttcggatctatcaggaggtcaatcatttaagagttctgcatgatgaactaagagaagagacattaacattagcgcaacgtgatcaaatagttgcattacttgaaaaacaagcaaaagtcacttttacagcaatgagaaaggctttaggattttccgcattatttaatctcgaagacgcaaaacgtgatgggttaaaaggtaatgcaactgcagcagcattgtcaaagaaagacttattcggacctttatgggcagggttcgggactgctctacaagatgaaattgtaacacaactaatgactgaagaatcggaacctagattaattgcgtggctgcaggaacatacaggcgtcgatgaggctagagctcaagcaatagcaaacacaggcttaccggaaggatacggtagcttaggacgaacggcgttggcaagaatagttccggaattacaaagggatgtaataacatacgataaagcagttcaagctgcaggatttgcgcatcactcagatttgggattctcttttgaacacggtgctgatgaagtagaaaggatcggagaacgtacaatagcaagcactggagaaataaaacccgtatttgcattcaaacaattaccatattatggacgagcactccaaagacatgtagcatttgcaaaagataatccaaggaatgatgaggaacgatatggaaaaatcgctaatcctacagtacatataggactaaaccaggtaagagtggtcgttaatgccttaatgagaagatatggtagaccagcggaagtagttatagaattagccagggatttaaaacaaagtagggaacaaaaattggaagcacagcaacgacaggcagataatcagaaaagaaatgcaagaattagacgaagtatagctgaagtactaggtatatcagaagaaagagttcgaacactagatatacaaaaatggatcttatgggaagaattaagccatgacgctgcagatagaaggtgcccgtactctggtgtacaaatatcagcttcaatgttactaggagaaagagtagaaatagaacatatccttccattttctatgacactagatgattcattaaataataggacagtggcattaagagaagcaaaccgtatcaagagaaacagggccccctgggaagccagagcagattttgaagcccaaggttggagctatgatgggattctacaacgagcagaacgtatgccactacgaaaaagatataggtttgcaccagatggttatgaacgctggctaggagaagataaagatttcctcgctcgtgcactaaatgatactaggtatttgtcaagggttgcagctgaatatttaaggctagtgtgcccaggatcagcgacaagggtaataccaggacaaatgacagcactattgagaggaaaatttggtttaaacgatgtactaggtttagatggtgaaaagaataggaatgatcataggcaccacgctgtagatgcatgtgtaattggagttacagatcaacggatgatgcaaaggttcgctcaagcaaatgcgcaggcaagagaagacggattaactagattggttgaagacatgcccctaccttggcccacctacagagatcatgtcgaacgagcagttcatcatatttgggttagccataaaccagaccatggctttgagggagcaatgatggaggaaacatcgtatggaattttaagagatggctccataaaacaaagaagaaaagcagatggaagcgcaggaagagaaataagtaacctcatcaggattgccgaaccaggtcaaccccaaaggcatggagtagatgctgaaggacgccccttaccttacaaaggatacgttggagggagcaactattgcattgaaataacagtaaatgataaaggtaaatgggagggacaagtcataagtacgttcgatgcgtatagaatagtcagagaaggcggtttaagacaactaagacatcctacacaaggtcaaaacggtagggcattagctatgagattagttataggggattcagtaagattagaagctggggaaggaagtttacaaacattaagagttgcaaaaatgtcagcagcgggacaagtatttatgagcgaggttaaccaagcaaatgttgatgcaagaaatagaaatggggatttaccttatgtatccaagatggcaggaagttttcagaaagctagagctcgccaagtaacaatctctcctataggagaactaagagatcctggatttaaaggatga

SEQ ID NO: 4939 - RNA, 3135 nt, synthetic construct
  misc_feature 1..3135: note = Cas9 variant
  source 1..3135: mol_type = other RNA
atgaaatacacattaggtctagacttgggctacaacagcataggttgggcaatacttgaaaacgacgaaaacggaagcccgataaaattattcaatgcaggagtacatatattcgaaccttcaatcgaagacatagagatagacgggaaaggcaaaaccaaaaatgtcaaaagaagagaggccagactcagaaggcgacaactattcagaaaaactaaaagactcgaaaaactcctaaattttttcatccaggaaggatttttccaaaatcagaaagtattaataaacgatcccttcgaacgagcagaattcttatatcaactagataaaaaaagcagaaacccatacatactacgcagagaagcactagacaacagactaagcctagaagaaatagcaagaatcttctatcatatagcccaacacagaggattcaaaagcacaaaaagagaacttgccgaaatgaataaagacgaaaaaaaaaaaaaagaagacggaataattcaaagtgaaatcaacacactaaaggaagaaataaaaaaaaatagttgtagaactctaggagaatacttcgccaaactatttgaaaacggagaaaaaatacggggtcgtcatactgacagaaaaatgtatgaagaagaattccaaaaaatttttaacaaacaaaaggaattctaccccaatatattcactgacgaattcaaaaaaaaactatataaattaatcttccatcaacgagaacttaaaagtcaaaaagataaagttggcttctgctccttagaacgaggaaaaaaaagagcaccactggcactacttgtaagtcaacgatacagatacatgtgcaaagttaacaacctaaacgtcatagacaccgagactggagagaaccgagaattaacagtagatgaaaaaaaaaaactctacgaaaaactagaaaacagcgaaaaactaagctttaaagagattaaaaaaatcctgaacctctctgagaaaagatacatattcaacctcgaaaaaagcgaaaagtatattataggcaacaaaacaaatgtaaaaatgaaaaacatcatcaaagactgggacaacttcgacgaggataaaaaaaacttttttataaatgaggcacgcactgtggtaaaaatagaaaccttagaaagacggggaaagaaactaggactcagtgatgaagaaagcaaagaattcagcaaagtagtattcgaagatggatatttaaacttcagtaaaaaagcagtagaaaaattattaccatacctaaaagaaggaaaaaaggaatacgaagcgataaaattagcatatccagaaaattccgttcaaaatgataacctaaaagagctggatttcctaccaccaataaaatccaaagaactgaaaaaatacttcgaggtacgaaacccaatagtagaaaaagcgttaacagaaacacgatacctagttaacttcctaatcaaaaaatacggcaaaccggaaaccataaaaatcgaacttgctcgcgaattaaaactttcgaacaaacaaaaagagcgaaaacacaaagaaaaccaagaaaaccgtaagaaaagagaagaagtcatagaaaaactaaaaaacgacttaaaaatatcagaaccgacagaaacacaaatccaaaaataccttttggcagaagaatgcgactgtaaatgcccctatactggtagatctatctcaatggacagtttattcggagaacaccctttgttcgacatagaacacataatcccgtttgatcgaagcctagacaattcgttcctaaataaaactctatgttacagcgaagaaaatagaaaagtaaagcacaacaaaacaccctatgaagcctattatggaacagagaaatgggaggccataattgaacgagtgaagaagttcaaaagcaacgtaagaaacgaaaaattaagaaggttccaaatgaccaaagaagacgtagaaaactatatacaaaatttttcaacacaaaatctaaacgatacaaaatatgcaagcaaattagccaaaaaatatctcggactactatatggaagcataaacgaagacggcatagataagaatcgtaagagaagaatttttgcatcatcgggaaaggtaacatccacgctacgatacgcactagggctaaataccatattaaacgacgaaaacatcaaaacacgcgaagaccatagacatcatgcaattgatgccataacaattgcattaacagacagttctatgataaaaaaaatatcagatgctagcaaaagagaaaaaaacataaatagcttattcaaagatttccaagctccctgggaaaatttcagaaaagaagtcgaagagataatcgcaaaaatgaatatatcgataagaataaataaaaaagtatccggacaaatacacgatgaaacattctataagaaaccgtttaaagaagaagagaaaagctatacacaccaacgaatcaacctcgaggaactaacaataaaagatgaagacaagaagaagcaatcttccaaattgatcgacaacattgtagactctaaaataagaaatataataataaatagtcttaacggagaaaagccaaagattaggtttaaggacccaaaagaccacccatacatcatccagaaaaacggaaaaaaaatacaaatacataaagtaaccattaaaacaaagctcgaaacatacaatgaaataggaccagaaaaagcaaaaagatacgtaaaatcgagtgacagtcaccacatcgaaatattcgaagacttaaaaaccaagaaatgggacggctacgtcgtaagcctactagaagcatacgaacgaaaaaaaaaaaaattaccaatcgtaaacaaaaacctaggcgaaggtaaaaaatttttattcagcctagcgaaaggagaaatcatagaacttgacacagaaaatggaaaacgggaactattcgttgtaagaataatctcggcctcaaataatcaaattaagttcacaagaatcaacgactcacgtaaaatcaccgacataccagcaacgggcctgacagcttgcccatccagcttaaagaaaagaaactgcaaaaaggtagtcataaacatactaggcgaaaagcactacagtaacgattga

SEQ ID NO: 4940 - RNA, 3135 nt, synthetic construct
  misc_feature 1..3135: note = Cas9 variant
  source 1..3135: mol_type = other RNA
atggcagaaaagaaatttaaataccggttgggattagacctaggcacaaacagtatcggatggtgtatgctaagacttaacaaagacaatgaaccagcagcagttataaaatctggagtcaggattttccacgacggaagaaacgagaaaaccaaagaacccttagcagtagttagaagaaacgctcgaagcatcagaagaaatctagatcgaaaaatctctagacgtaatcatcttttaaacacattggtcaaatattttctacttccaagcaatgaaatcgaaagaaaagccctagctgtactaaacccctacgaattacgaagtcgagcagtaaacgaaagattagaactattcgaactaggaagactactcatgcacctttcaaaaagaaggggattcaaatccaatagaaaagtagataaagaggacagcagcggcaaaattaagccagcaatagagagacttaaaaacaaaatgcaagaaacgaataagaaaaccgcaggggaatacctgtatagcctcatgcaaaacggaaaaccagttagagcaagattaggcagaattgatggatcaaatggctacgagatatatttagatagagcactaatagaagaggaatataacttaattatgaatgaacaaaagaaacatcacaaagaattaacagacgatatcataaacgaaatctttaacatcatattctaccaaagaccactaaagaaacaaataatcggcaaatgcagtctcaccggagaagacacaaaactaaagaaagcacacgttctagcacaagattttatcttgttacaaaaagtacaagacctaagagtattcgacgacaaccaacttgagttccgaccattaagtaatgatgaaaaagacataatcaaaagagaattacgcaaaaagaaagaagtaagttacgaaaacatcagaaaattactcaagaaatactatgaaaacgttaaatatggtatgttctcgcatgaaacgctatataagaaacttcaagggaacaaaacaaatgcacttatgtcagataaagaaatcatcggagacagctggtattcactatcccccgaagtacagtacgatatcatagaggaactatattccgacaaagacaatgacgagttaagcaaactctattcagaaaaattcaacttaaatgaaagccaaataaacggattgttaaacaaagccatctatagacttgacagcggttatataagatatggcaaaacagcagtcacaaatttaaattcaatcatggacaaagacaatttaaaccttcatgatgcaagagaagaagcaggatacgaaaaagaaaataaacaagatgcatccgaatacctagagtactacggcaaagtattaccggactccgtcgttgatcctcaaatagaaaatcctaaaaacgacgaagaaagatatggaaaaattgcaaacccaacagtacatgccgctctcaatcaactaagaaaattagtaaacgaactaataaaactatatggcaaaccagagcaaatcgtaattgaactagctagagacctcaaaaactcaagaaaagcaaaagatgttatcaataagaaaattgccgaaaaccgaaaattaaatgaagaagtcgataaaacattacaagaatattcagaaaaatacaatacacacatagtgaaaaacaaattaaatagagataaagtaaaactatggagggaattaggaaaagacccattagaaagaaaatgcatatacaccggagagcaaataaatatagcaaaactattttctgacgaagtccaaatagaacacatagtcccatactctaaaacattagacgattcatttaacaacaaaacattatccatgaaacaagcaaactactacaaaggaaataaaacaccatacgaagcatttaaagacagtaaagatggatataactatgatgacatcatagcgcgggcaaaactcctaaacaacgacaacaaatttaaacggttcacaaaagatgcaatggacatatataatagagatggcaaagattttatagcccgacaactttcggacacacaatatctatccacacgagcattaatttatttacagagcttatacgaaaaagcacaccacagtagcatatggacaataccgggacaacttacagcattaataagaaattaccttggtctaaacaccctaatatcaaacgataaaaataaaaacagaaatgatcaccgtcaccacgcagtcgacgcattcgtagtagcagtcacaagtagatccctactacagaaaatatcatatgccgcttcactccaagaagacctagacaatagaaatgtaagtagttacagaaacaaactattagagaaaatgcctgaaccgttcccaaactaccgaaaatctctagaactagctatcgacaacatcaaaacatcacacaaagctgacagatcaataagtggaaaactccacgaagatacagcatatggaatagtagaaaacgacgacaaatacaatgttgtaacaagatggactgttgacaaattcaaagaacaaaaacacttcgaaacaataagagacaatgagctcaaagagatcgcatgtagtgacaaagaactattcgcaaaaatcgtggaaaccagaaaaatcaaatctataagaaaactcgccaaagaaaaccccgtaataaaaatcaaagataaatccggcagagattataaagcatttgcaggaggaaacaacatttgcgtagaaatatacgaagtcgatggagtcagaaaaagcgaagttatccaattatttgatgctgcacaaaaaggatttatgccggaatggatgaagaaatacccaaacggtaaactattgatgagactattcaaaggcgacgtaatcggatttatagaaaacagaaaatataattattacacaataaaagggatctcaatagcagatcaaaacctcaaattgctagccatcaataaagcagaggggatattcaagaaaggtcttaacatactattcgattccaataataaaaatagcttaaacgcaaaacaattcaacatatcagtaacaggaatcgtaactaaaaagaaaacagccgatgtaaatttctggaaaaacagaaaatga

SEQ ID NO: 4941 - RNA, 3135 nt, synthetic construct
  misc_feature 1..3135: note = Cas9 variant
  source 1..3135: mol_type = other RNA
atgctacacaaaatgcgatacagattagctttagacctagggtctactagcctaggatgggcaatggtcaggcttaatgcaaaccaacaaccatgtgcagttataaaagctggcgtacggatattctctaatggaaggaacccaaaagacggaagtagtctagcagtaactagacgagaagcaaggtcaatgcgtagaagaagagataggctattaaaaagaaaggcccgcatgatgagaacgcttattgaatacggattcttcccagctaacgaaacgcaaagaaaggcactcgaaaatttaaatccttatgctcttagagccaagggactggatgaagcgttaactccaagtgaatttgctagagcactattccacataaaccaaagaagagggtttaaatcaaatagaaagactgacaagaaagactcggatagtggcgcgctgaaaacagcaataaaacaattacattcagttttagacccacaaggaaatgacggcaagccaagaacagtaggagaactactatataagcgattcacagatttaagtaaactaccaaaagatcgaacagtacgagctaggtatagacaagacaaaatagttaaagacgacggaaaaaccaaaatagacaaatattatgatttatatatagatagagcaatgatagaacaagaatttgatgccttatggaagaaacaatcagaattaaaccccatattgttcaccgaaaatgctagagcagacctaaaagacgtactgctatatcaaaggagtctaaaaccagtaaaaccgggcagatgcacattcatgagtgaagaagaaagagcacccctcgcattaccaagtactcaacggtttagaatgtatcaagaagttaataatctccgaatacttagagagggattaaaagaagaatcattgacattacagcagcgagacgatttaattaacgcactagagaaaaacaacaggaggacctttacacaaataaagaaactattaggagtaggtggatcagtacaatttaattttgaagaccctaaaagagaagaactaaaaggaaatacgaccagcgcaatattgggtaaaagcgaacatttcggggaagcatggtttgcatttaacgaagcaaaacaagatgcaatagtactccaattaataaaagaagagaatgaagcaaaattagtacgttggttacaagacgaaactggtatagacgagaaaagagccgaagtcatagcaaatgccggattaccagaaggttacggatcattatgcattgaagccctagcacgaattttacctgaactaagaagagatgtagttacatatgacaaagcagtgcaagcagcaggatttgaacaccactcaaaattgaatagaaatgaagaaataccagatattacatttaagattgaatcaatagatcgaaattcaggagaaatcaaacaatttcatctacacaaagaactaccctattacggtgaatacttacaacgtcatgttggatttggttcaggcaagccagaagactcaatagagaaaagatatggaaaaatagccaacccaacagtccacataggactaaatcaagtaagggtagtagtaaatgcactgattaaaagatacggacatccatcagaaataattgtggaagtggcaagagatttaaaacagagtaaagatagaagggacgaagaaaataaaagacaagcagaaaatcaaaagagaaatgaaagactaagaaaagacatcgctgacatattaggaatttcggaggaacgagtccgtcgggatgatatagaaaagatgatattatgggaagaattatcttttgatccagcagaccgcagatgtccatattcaggcgtccaagtctcaacagtaatgctactaagtgacgaagtagaagtagaacatatattaccattttcacaaactctagatgatagtttgaataacaaaaccgtagcgctaagacaagctaaccgaataaaaggcaacagaacaccatgggaagcgttcggaacatccaacatatcgggattcgactactcaggaatattaacacgagccgaactaatgccgaaagcgaaaagatatagatttgccgaagatggataccagagatggctaaaagatgacgcgggattcctggcaagagctctaaacgacaccagacatttgtctaaaattgcaagagaatatatgtcattaatttgcccaaatacacgcgtaattcccggacaaatgacagctatgctcagaagaaatttcggacttaatgacgtgcttgggctgaatggcgagaaaaatagaaatgatcacaggcatcatgcagtagacgcctgtgtaatagccgtgacagatcaaggattactacaaaggtttgcagcagcaagcgctagcgctagggaaagacaacttaatcgcctagttgagaacatgcctctaccgtgggagtcatacagagaacatgtaagacgagcgattgatggaatctgggtcagccacagacctgatcatagccatgaaggtgctatgcataacgatactgcatacggcttgaggggaaatgggagggtatcgtttcacaaaatggtagagggaaaaagagagtatattgaagacaacttaaaagtaatagaaataacagacactaaagcaatagacagacatggattactcccaaccggaaaaccaagaccatataagggatataaaggtgactccaactactgcattgaaatagtaagaaatgaaaaaggcagatgggaaggtgaaataatatcaacatttgatgcgtaccagctagttcggaagtacggtatagtccaactaagatatccggtattatcagtaagtggtaagcccctagtaatgaggcttatcaggaatgactttgtgagattagaacatgaaggcataacaagaaccttaagagtatgtaaaatgagagaagacggacaggtcgcattagcagatgtgacagaggcaaacgtagatgcaaggactagaaccaaagaaatatgttacgtctttaaaacaggagggtctctacaaaaggcaaaagcaaggagaattacaataagtccaattggagaattgagggatccaggctttaaagaatga

SEQ ID NO: 4942 - RNA, 3138 nt, synthetic construct
  misc_feature 1..3138: note = Cas9 variant
  source 1..3138: mol_type = other RNA
atgcaaaaagaaaaaccattagcatacagactagccttggatttaggtagtacatctctaggatgggcagtattaagactgtccgcgccaggagagccaagcgcagtcattagagcaggttcaagaatatttagtgacgggagaaatccaaaagatggaagctcgctagcagtgacgagacgagctgcaagggcaatgagaagaagaagagatcggctcttaaaaagaaaagccagaatgttagctgcgttagaaagacatggattcttcccacaagatgaagctgcaagaaaagctctagaaaaactaaacccatatggacttagggccagaggattagaatcagcactaaagccagaagagttcggtagagctctctttcatctcaatcaaagaagaggatttcaaagtaatagaaaaacggaccgaaaagattcagattcaggggcacttaaacaggcaatagggacactaagagcccaaatgcacgaaagtggttgtcgtacagttggagaatggttctggaaagtgagaatggaaagaaaaccggaaggggtaaaaggacaaggcgtaagagcaagatatagggaaaccccttttacaacagatgaaggtaagaaacgtatagataaaagatatgacctatatgtcgatagagcaatggtagcacaagaatttgatgcattatgggctgcacaagctactttcgcaccagccctattcaatgaagcggcacgtgcagaactaagagacatattattgcaccaaagaaaattaagacctgtacagccagggcgatgtactttagtaccagaagaacctcgagctcttttggcattaccgtcaacacaaagatttagaatctatcaagaagtaaaccatctaagggtacttcacgatgaactaagggaagaagcattaactttagctcagagggaccaaatagttgcattattggaaaggcaagcaaaggtaacgtttacagctatgagaaaagcactaggcttctccgcattatttaatcttgaagacgcaaaaagagatggactaaaaggcaatgcgacaacagcggcactaggaaagaaagatttatttggtcctttatgggctggttttgatacagctttacaggatgaaatagtaacccaattaatgacagaagagtcagaacctagactgatagcatggctccaagaacatacaggagtagatgaggcgagagctcaagcaatagcaaacgcaggattaccggaaggctacggaagtttagggagaacggctttagcaagaatcgtacccgaactacaaagagatgttataacctatgataaagcagttcaagctgctggatttgcacatcattcagaccttggcttttcttttgagcatgacgcagatgaagtagaaagaataggtgaacgcactatagcgtcaacaggtgaaattaaacctgtatttgcattcaaacaattaccgtattacggccgagcactacaaaggcacgttgcgttcgccaaagaaaatccaaggaatgatgaagaaagatatggtaaaattgcaaatcctactgttcacattggactaaatcaggtaagagtagtagtaaacgcactaatgtgtagatatggaagaccgacagaagtagtgatagaattggcacgagatctgaaacaatctagagaacagaaattggaggctcagcaaaggcaagcagacaatcaaaaacggaacgctaggataagacgaagcattgccgaagttttggggattagcgaagaaagagtcagaacactagacatacaaaaatggatactgtgggaagaattgagtcatgacgcagcagatcggagatgtccatattcaggagtacaaatttcagcatcaatgttattaggagaaagagtcgaaattgaacatatacttccattttctatgacattagacgatagtttaaataatcgaacagtggcattacgagaagcaaacaggataaaacgaaatagaacaccatgggatgcaaggacagattttgaggcccatggttggtcatacgacggaattttacaacgcgccgagagaatgccacaaagaaaaagacaccggtttgcacctgatggatatgaaagatggctcggtgaagataaagactttctagctcgtgcattaaatgatacaaggtatttatctagagtagcagctgagtacttaagattagtttgcccaggatctgcaacacgagttataccaggacagatgacagctctacttagaggaaaattcggattaaatgatgttttgggcttagatggggagaaaaaccgcaatgaccatagacatcacgcagtagacgcctgtgtaataggagtcacggaccaaagaatgatgcaaagatttgcgcaggccaatgcccaagcccgagaagatggtctcacacgattagttgaagacatgcctcttccatggccaacatacagggcacatgttgagcgagcagtaaggcacatttgggtaagccataaaccagatcacggcttcgaaggagctatgatggaagaaactagctatggaatacttcgagacggaacaataaaacaaagacgcaaagctgacggatcagcaggccgagaaatcagtagattaatcagaataacagagccaagccaaccgcaacgacatggggttgatgcagaaggaagaccacttccatataaaggatatgtgggcggaagcaactattgtctagaaattaccgttaatgataaaggaaaatgggaaggtcaagtaatatcaacattcgatgcatacaggattgtcagagaaggaggattgagacaactaagacatagcactcaaggacaaaatggacaagcacttgccatgagacttgttataggagactcagtaaggttagaagtcgacgaacaagaacgcgtaatgagaatcgttaagataaatggtaataatgggcaggtcttcatggccccagtacatgaagcgaatgttgatgcaagaaattccgataaaaatgaagcattcgcatacacatcaaagattgcaggcagctttcagaaaacaaaggcaagacaagttacaatcagtcccattggagaattaagagatcctgggttcaagggatga

SEQ ID NO: 4943 - RNA, 3138 nt, synthetic construct
  misc_feature 1..3138: note = Cas9 variant
  source 1..3138: mol_type = other RNA
atgaaaccaagaaacctgaactatatcttaggactagatctaggcatagcatcagttgggtggagcgttgtcgaaattgacgagaatgaataccccataagactcatagatgtaggtgtaagaacatttgaacgagctgaagtccctaaaactggcgaaagcctagcactagctaggagactagctaggtccaccagaagattaatacgaagaagagcgttcagattattaaaagcaaaaagactactaaaacaccaccaaatagtcaatgcagaagaattaacacagctaccaaatcaatgctgggagttgagagtgaaaggactcgattcactactctctaacaccgaatgggcagccgtgttactccatctactaaagcatagaggatatttaagtcaacgcaaaaatgaagcacaaaacgcagataaagaactcggaaaactccgtgaaggaatggacaacaactcaaaactgttactagaaaacaattacagaactcctgctgatattgcagtgaaaaaattcgccgtagaagaaggacatatgagaaatcaaaggggggcatatacccacaccttcaacagattagacatcctcgcagaaatgcaactattattcaaaacacaaagagagcttggttctacatatgcaaatggtgaactagaacaagctttttgtgaattattattatggcaaaaacaagcactaaaccgaagccaaatgttaagtctagttggaaaatgtaccttcgaaaaagaagagaaaagagcagcaaaagcatcatactctgcagaaagatttgtagcaattcaaaaactacaaaatttacggatcctagaaaatggagaagaaaggggattattcgatagcgagttctccttactactagaaaacgcttacaacttaaaatcaggacttacatataagcaagttcgtaaaatcctaagtttaagtgaaaacgctatattcaaaggactaccgtatttatctgatgacctggaaaaaccagagaaaacacaattcttagcgttcaaattttatcaccaactggcagatatcttaaaaaacaatggattttcagatgaatggcaaaagctatcacaagagccaaccttactagacaaactaggaacagaattatcactatgtaaagaagaaaatgaattcatagcacaattcaatggagaattgccagaagcaatgttatctacgctcttcaaccataccaatttcgacaaatttatacatatatcattaaaagcacttaataacatactaccactaatggaacaaggtaatgattacacaaaagcttggcgtaaagtatacccggaaccaacgaaaaaagatgaaaaaacactcccaccaattccagcggatgagattagaaacccggtagtcttgagaagcctaagccaggcgagaaaggtcataaatgcggtaatcagactatacggctcacctgcccgaatacacatagaaacagcccgtgaactaggaaaatcatatgacgatcgccaaaaaataaaaaagcaacaagacaaaaattcagatgaaagagaccaagcagtaaaaaaattcctcgaagaatgccctaactttgcaaacaaagtaaaaggcaaagacatattaaaaataagactatacataaaccaagatggaaaatgtctatactcggggaaaccactagatccacatagactattggaaataggatatgttgaaatagaccatgcactaccattttccagaacgtgggacgattcacaaaacaataaggtcctagtactagcaaacgaaaatcaaaataaaggcaaccaaacaccatttgaatggttaggtaaagacgaacatcaatgggcactgtttgtagcacgagtaaacggatgccgattcccatacgcaaaaaaacagaggatacttacaaaaaaattagacgaacaaggtttcttgaaaagaaacttgaacgatacacggtacgtatccgcctacttaatgaaacacataaaggaaaacctacacctagttggcaaagggagtgataaagttttcgcatccaacggccaagtaaccaattttctaagacgatgttggggattagaaaagaaaagagaagaaggtgacagacatcacgcactagacgcaatcgttgtcgcgtgttcaacggcttcaatgaggcaaaaaattacattatttaagaaataccaaagatggaatttaaaaactggaaaacatattgatcaagagacaggcgaaataataccactacacttcccagctccatgggatttcttcagacaagaggttatgatcagaattttcagtgaaatgccacaagaagacttaataatgcaactaccagacaggccgcaagccaatcatgaatttgtacaaccactatttgtttctcgtgccccatcaagaaaaatgtccggtcagggccatgaagcaaagttgagatcagctagaatgctggaagccaccggcaaatcaatcaaaaaagaatttttaaccgatctgaccataaaaaatctagaacacatggtcaacaaagaaagagaaccagaattataccaagcattagtcgaacacttcaaaaaatacggagataaacctaaagaaaaattttttaaaaaggggggagtagaagtaaaatcaataagaatatcaaaaacccaaaataaatccgtaaatctaggaaataaaactattgcagataatggcgacatagtacgcacagacttatttttaaagaacaaaaagtattacttcgtaaacatatatgcatggcaagtttcaaaaggcatactccctaaggaaacaacaaccggaaacatactggacaacagttacgagtttcaattttcgttatttaaaaacgacttattagaaataccccatccaaaaaacgagaacgatagtatacttgcctactttatacgaccagacgacgaacgaagatggatccttaaattccatgataacgcaaagatacccgatatatatggtaaaaaagacgaaacttcaattagactctccattcaaggacaaaagttcataaaaaaataccaagtagatgaactcggaaagaatattagaccatgccgacctactaagagacaaggagtacgatga

SEQ ID NO: 4944 - RNA, 3141 nt, synthetic construct
  misc_feature 1..3141: note = Cas9 variant
  source 1..3141: mol_type = other RNA
atgaaaatctacagtttcgacataggagtggcaagcattggatgggcattcatagaaaacgaagtcttacaagattgtggcatacgaatcttcacaaaagcagaaaaccccaaaaacggagcatctctagcactaccacgaagagaagctagaggagtacgtaaacgattagcgcgaagaaggggacgcctaaacacaataaaacaactactgtgtaaagaatttggattacagctagaagactacttaagtaacgatggagaacttccaaaggcttatacggcatcaaaagcaaatcccttaaaatcaccatacgaactacgtacactagccctaagccaaaaactcgactccaaagatttagtaagagtcatccttcatatagccaaacacagagggtacggaaataaacacgccaaagactcaaaagacactgaatcaggaaaagtcaagaaagccatagaatttaacagaaaaacacttgcagaaaaaggttatcgttcagttggtgaatatttatacagagagttctttcaacaaagcagaatatcacaaaacaatggcgcaactgagtttgtcaacgtaagaaataaaacaggcaattacgaacactgtgtagctcaagacatgttgaaagatgaactagaattaatattccgcaaacagaaagagttaggattacacctatcagatggttttgaaaaacaattacttgacaaaatattcgaacaacgacccctaaagtccttcgctgataaagtaggaaaatgccaattcattgccggtgcaaaacgagctcccaaagactcaattagcgccatagaatttgttgcactatcaaggataataaatacactagcaaacttatcaaagaaatcgggagagatgtacgataaagcaatggtactaacaatcctagattctgtactagaaaaaggcgagatgagttactatgccctgcgcgaagcaattaacctagacgagaaaataagattcgccgactcaagacttgattactccaaagaaataaaagaaacagaaaaagtgaaattcgtagaatgcaaaaatctaaaatctttcaagaaagtattaggaaattgctacaaaaccctggagcgaaaacatatagactccattgcagaacgcatagcggtaataaaagatgtcgaaaaacttcacaaagaactagaaagctattgtgctactgaacaattatcactcacatcggaacaaatccaagcactatcccatttaaacttttcttcacatatatcattaagcctcaaagcattagaacaaatccttccattcatgagaggcgaacgagaagcaagaagctcagatgcagactattgcatcggaatcgacgaatctggtgaaagccaatgcctgagatatgacgaatcagtagaaaaagccgggctcaaggctttatcaaaagacacgctaaaaggacaaatattaccccctcttaatgagttcgaaccctacctagcaaatccagtagtagcaagagctctagccgaatatagaaaagtcttaaatgcactactcaaacaatacggctcaccacacaaaatacatatagaatacgcaagagaggccaaactaaacacgacagaaagacaaaaatacgaaaaagaacaaaaagacaactacgccgcaaaccaagcagcacataagaaatgccaagaactaggcttggaaccctctagcactaatttactaaaacttaaactgtggcaagagcagggaggcttatgtttatacagtggtgctaaaattacaataagctacctacaagaccccacagcactacaagtagaccacatatatccatactcgcgatcattcgacgatagctatatgaataaatgcctagttctaactaaagctaaccaagaaaaaggcaatagaacaccttttgaagcatttggcacagatagcgcaaaatggggtgtaattacaaccttagcacaaaaattaccccataagaaaagaagaagaatattaaatacagcatttaatgacaaagaagcaggctttaaattaagaaacctaaacgatacttcttatattgcaagacttgtagctgactatacagaaacctacttagaatttctctcattggtagaatcagagaacacaacattgggaaaaggacaaaaaggaagcaagaaacacatcgcaatagtcaacggcgccctaacatcaactatgagatactacctaggtttcgcatcaaaagatcgggacaaccatctgcaccacgcattagatgcagtcataataggtttcatgaatgactctgtgattaaagcattctccgacttcaagaaaactcaagaaacatcaaaagcagcatactatgcacacacattgtccaaacaagaatacaagaaacaaagagcttttatccaactcccctcaggggaaaacttccgagccaacgtactagagaaagctgaatcagtcttcgtaagtaaaccaccacgaaaaagggtaagaggcgcactacacgaggagagcttttactctcaaaacgacacaaaacttctcaaaagttacggcggtgcagaaggtattgaaaaagcattacaactaggcaaaataagacaaataggtacaaaaatagtatcgaacggagcaatggtacgcgtcgatattttcaaacatcgaaaaagcgggaaattctacggagtacccgtatacacaatggatttcgcattagggatactacctaacaaagctgttgtccaaggcaaagacaaaaacgacgtaattaaagattggctagaaatggattcttcctatgaatttatatttagtctatacaaagacgacctactattagtacaaaagaaagaaatggcagaaccagaactttgttactttgtctcattcgatacatctggggcttcaattaaagttgcaaaacacgacaacaattttagcactttaaccgaaaatcaaaaattacttttctcaaatgcaacaaaagaagaagtagtaggaaaatcaataggtattcaaaatttaaaagtttttgaaaaatggcaagtatcagtactcggagaagttaaaagaactcaaagttatccacgagaaaacatatcactagcatcaaaagctaagaaatga

SEQ ID NO: 4945 - RNA, 3144 nt, synthetic construct
  misc_feature 1..3144: note = Cas9 variant
  source 1..3144: mol_type = other RNA
atgaaactcttacgatatatattaggactagacctaggaatagcatctgtagggtgggcaattgtagaaatagacgagaatgattttccaataagattaatagatataggcgtcagaacttttgataaagctgaagtatccaaaactggagaatcattggctttggcaagaagattagccagaagtacaagaagattaatacgaagacgagcatttagacttctcaaaggtaagagactattaaaacaacacaacgtaataaataaggaggcattaaccacactaccaactgattgttgggccttgagggtaaaaggacttgacgaaagattaagtccaaccgaatggagtgcggtcctattacatcttctgaaacatcgaggatacctgtcacaaaggaaaaacgaagccaaaagtgcagacaaagagatgggagccctccttagtggagtagcctcaaaccatcaactcctagtggaaaaccaatttagaacgccagcagaaatagctgtaaagaaatttgccttagaagaaggtcatataagaaatcaattgggagcttatacacatacatttaatagacttgacttactggcagaaatgaaactactatttcaaacacaacgagaacttggaaacccccatacaagtggccaattagaacaggaattttgtgaactcttaatgtggcagaaaccggcattgagtggagacgctattttgaagatgctaggtaaatgcacttttgaaactaatgaatataaagcagccaaacactcctacacagcagaacgttttgtatggctaactaaattaaacaatcttagaatactcgaacatggatcagaaagagtactaaacacagatgaacgaagtctattattaaaccaaccatacgaaaaagcgaaactaacatatacacaagttagaaaactactcggactatcagaagaagctagatttaatggtgtgagatacggtaaagaaaaagcagaagatgcaaccttaatcgaactaaaggcttatcacgctataagaaaagccgtcgagaaagcagacaaaagcgcatgggaaactttgaaaaatcaaaccgcattattagacgaaatcggtacgacattttcaatatataaaacagatgacgatatcactgagcagttaaatggaaaattgagcgacacagtactaaacgctttattagagaacttaaattttgataaattcatacaattaagcctaaaaagtttatataacattgtacctttaatggaacaaggcctaagatacgacgaagcatgtcaacaaatatacggagaccactttggaaagaaatctggagaaataaacaggttactaccaccgattccagcagatgagatacgaaatccagtagttctacgatctctaactcaagccagaaaagtaataaatgcggtcataagattatacgggagccctgcaagaatacacatagagacggctagagaactaggtaaaagttacaaagatagaaaagaaatcgagaaaagacaagaacaaaatagagctgaacgcgaaaaagcgaccgctcaattcaaaacactcttccctacttttataggggaaccaaaaggtaaagatattttgatgatgcgactctacgaacaacaaaacggacaatgcctatacagtggaaaaccactaaacctaaatcgtcttttagagaaaggatatgtagaaatcgaccacagcttaccgttctcaagaacatgggatgacagtcaaaataataaagttcttgtgctagcaggcgaaaaccaaaataaaggaaatcaaacacctttcgaatggctaggaaaagatgaacatcaatgggcactattcgtagcacgagtaaacggttgtcgatttccctacgcaaagaaacaacgaatattaacacaaaaactagacgaacagggttttattgaaagaaatctaaatgatactagatatattgcacgctttctagtaaattttgtacgagaaaacttacatttaactgggaaaggcaaaaatagggtattcgcaagcaatggacagataacagcatttctaagaggaagatggggacttagcaaagtaagagaggaatcggaccgtcaccatgcactagacgcggtagtagtagcttgttcaaccgtcgcaatgcaacagaaaattacacggtttgtcaaatatcaagaaggaaacctacaaacagcagaaagaatagacagagaaacaggagaaataataccattgcattttcccgacccttggcatttctttcgacaagaagttatgatccgaatctttagtgaaaacccacaagaagatctaataatccaattaccggatcgtccagaagccaatcacgagttcgtacaacctttgtttgtctcaaggatgccaacacgaaaaatgagcggtcaaggacatatggaaaccataaaaagtgccaaacgacttgatgaaggaatttcagtctccaaagtaccactaacacaactaaaactaaaagacttagacaatatggtcaatagagagcgtgaaaaagcattatacgaggctttaaaagcaaggctcaatgcctttaatgatgacccaactaaagcatttgcagaacctttctataagaaaggtggacaacaagtaaaagcagttagagtagaacaagtacaaaaatccggtgtagttgtaagaaacggaaatggagtagcagataatgcatcaatggtgagagtcgatgtattcataaaagggggaaaatatttcttagtacctatctacacctggcaagtcgcaaaaggaatattaccagatcgggccgttgttgctgctaaagatgaatctgaatgggaactcatggacaaaacagcacaattccttttcagtatgtttccaaatgacctaattcaagttaaaacaaagaaagaaacattctttggctactataatggcttagaccgagcaacaggtgcgataaatctaaaagaacctgattcaaatataaacaaaggcaaaagtggactccatagaagcataggagtcaaaacagcactctcagtcgagaaataccaagttgacgaattgggtaaaaatataagaccatgtaggcccagtaagcgacaggcagtaagatga

SEQ ID NO: 4946 - RNA, 3147 nt, synthetic construct
  misc_feature 1..3147: note = Cas9 variant
  source 1..3147: mol_type = other RNA
atgaaaagactaggattagatataggaacaaattcgataggatggtgtctgatagaagatgatggagatggcaaaggaagaatcatcgatataggagcaagaatcttctcagacggtagagatccaaaatctggagcatctttggcggtagacaggagagccgcaagagctatgagacgaagaagagataggtaccttggcagaagaacagccttcctaaaagcactaaaaagattcggactgatgcctgcagatgaaagcgcggccaagttacttgcagacagagacccatatgaattacgagcaagagcactagatgagagactagaaccacacgagatcgggcgagcattatttcatttgaatcaaagaagaggctttaaatcaaatagaaaagcagagagaaaaacaaaagatgctgaagacgggaaaattgctaatggagccaaagcgctggaccaggcaatggcagaaagtggcgctgaaacattaggacaatttctttcatcacgagatacaaaaagagtaagaatgggaagcgatgctcaaggctatgacttttatccgcaaagaaggcatgtagaatatgagttcgacacaatatggagccgacagcaacaacatcatccagcactgctaacagaagaagctcggaagaaattacacgacattttgttctttcaaaggcccctcaaagaacaggaagtaggtgtatgtacctttgttcataacgaatgccgactacctaaagcacatccactattccaagaaaggcgattatatgaagaagttaaccaactagaaattacaactcctggagccccgaatcggaaattaacaatggatgagcgagacgcccttatattagaattaagaagtagaaaagaaagatccttcgattcattggcaaaaagactgaaattagcacctggacagagctttaataaagctagtgaaagtcgaacccggcttcgtggagatgaagtatatgcagtaatggcccataagaaaagattcggagataggtggcctcatctagatagagatagacaatgggctataataaaacgaataatagaagaagaagacccagacaaactacatgcatttcttacaggagaatggggacttactgacgaacaagcgttagcaacagccagagcaccattaccagaattatatgggcgcctaggaccaacagcaacggcacgaatattagaggaattaaagaaagatgttatcacttatgatgaagcagtacgacgagcaggatggcatcacagtgatgacagaactggagaaatcttgccacaactaccttattatggagagctattaactagagacataccaccgggaacacaagacccaaatgatcccccggaacagagatggggaaaaataacgaatccaaccgttcatataggactaagacaactagaaaagctagtgaatgctataataaaagtacacggaagacctgatcaaattgtcgtagaacttgctagagaattgaaactaaatgagaaagacaaagaagaacacaatagaagaataagaagagacactgcagcagcgcaattaaggtcagcaaaattacagagtgaaggcatacccgatacaggagctaataggatgcttttgcgaatatgggaagaacttaatccaggagaagtactggatagacgatgtccatattgtggagaaccagtaggaatgagaatgttatttgctggggaagcagatatagaccacataattccatattccaggtcattagacgacagtgcaggaaataaagtagtagcgcataggagttgtaacagagcaaaagggaacagaacaccatatgaaaaatgggtccatgatccagacaggtgggatgtaatctcaacacaggtagctagattgcataaatcaaaacaatggagatttggcccagacgctatggcacgggtcgaaaaagacggtggatttatagcccgccaattaacagatacacaatatctatccagactagcaggacgatatttaagctcactctaccccacgaaagacgatggatcagtctatgtaataccaggacgtatgacagctatgctaagaagacgatggggtttaaatagcttattaccagatcataatttcgtagacaatgaacattcaaatgcaccgaaaaatagactagaccataggcaccatgccatagatgcagctgtagtggctgttacgactagagcactaatgcaagaaattgcacgaacagccggccgagcggaagataaagacttagaccgattatttgaagatttaccgcaaccatgggaaggttttagggaagagttaggtgaaaaattagtcagagtaactgtcagccataaaccggaccatggacgaaaaggtcttcctcctaaaaatagagatgtaacagcaggccgacttcacaatgataccgcatatggcctcactggtgacgtggcagcagacggaaaaacacccattgtagtccatcgggtcccacttatgtcgttaaaaccggcagatatatcggatccagaccgaataccagatcctgctctaagatcggcactccatagagcaacagatggactgagtggaaaagcgtatgatgccgcactagcgggattcgcaaaaactcatcctcaatttgccggaataagacgagtacgagttagagagccactaactgtaatccccatagcagatagagatgggaggccttttaaggcttataaaggagatgcaaatagtcgagttgatatatggcgaatgccagacggaaaatggctatctgatgttgtcactatgtatgaagcacatagaagagatcattcagaccgtcggccacatccagcagctaagaaattaatgtccctccgacaaaatgatatgatagcagtagaaagagacggggctccacgacaaatcatggtagtgaaacaaatatggcccacacaaattaatctagtagaacataaagaaacaggtaacttaaaagatagacatagtaatgaaactgaccctttccgctttttcgcgccaacggccggcggattaaagaaaatgaaagcacgacaagtaagaatagaccccctaggaagaatatttgatccaggtccaagatga

SEQ ID NO: 4947 - RNA, 3147 nt, synthetic construct
  misc_feature 1..3147: note = Cas9 variant
  source 1..3147: mol_type = other RNA
atggcgaacatagctgaaaatcttgtatttggaatagaccttggcataggaagctgtggctgggcagtgctaaatcaaaaagcaaaagatgaaaacatagttgccttaggatcgtggtgctttgacgtaccagaaactgataaagaaagaatacctacaaaccagatcagacgtgcaaacagactcttacggagagtaataagaagacgacggaatagaatggcagaaattaggcggttattcgcatctaagggaatgctagatacagcagacccagatgcgctagcaaaaatatcagcggatccctgggaaatgagggcaaaaggactagactatcagttaacaccgcaagaatttgcagttgcattaggacatatagcaaaaagaagaggtttcaaatcggcggcaaaaagagtatcgaccaatgcaccatcagaagatagtaaaatgctcgctgcgctagaaaaaacaaaggagcaaagtgcccaatatagaacaataggagaaatgttcgctagagatcccgcctatgccgatagaagaaggaaccgagatggatgtttcgacagaactatgtctagagaagatctatttaaagaaacacaaatactcttcgaatcacaaagacgcctaggaaattttagtgctacctctgaaaccgaacaagcatttatagatatagcatttagacaaaaaccaatgcaagattctgaaagactagttgaaacttgtctgttcgaacctgatgaaaaaagagcttcaagatttgcaccttcatttgaaaggtttaggttattgtgtagactagtaaatttgagagtaactgatggtttggaagatagaccactaacaccggaagaattaagacttgcatgtgaagatgctgggaaaacacgtaaattgtcagtaaagaaagtacgatctttaataggactacgagatgatcaacgattcactactatacctcccgatcaagaacaacacgatatagcggctagaaccggcgacgcattaactggtacggccacattccgagcaattctaggagaaagtttctggagacaattattaccacacccagaacaacttgacagagcggcatggataatttcctttcatgagttaacagacacaataattagcaagttagcgacgattggactaccttcagaagtaatggaacttataagaaaagccctagaagacgggaagtttagtaaatttaaaggagcggcaagtttatcagataaagccgcaagaaaattaataccgttcctacaagaagggctaacatatgataaagcttgtcagaaggcaggatacaaccatgcagcaagtaaatttacacactacgattcaatagatacaaaagcaaaatttaattctctaatggacgatgtaagagacagcattacaaacccagtggcaagaaaagcaataagcgaaggtatgaaacaagtatgggctatgagaaatcaatggggattaccaggagccatatgcattgaattagcaagagatgttgggaatagtgcagaaaaaaggcgagaaattgaaagtggaatcaagaaaaacaccgctcaaagagaacgtgagcgacaagaagctaaagaacaccttaaccagagtgatataagcagcgaaactcttttgagatatcgactatggaaggaacagggtggaagatgttgttacacggatcaacctataactccatcacaactaatagcaagcgataactctgtacaggtagaccacatattaccatggtcaagattcggagatgatagctacctgaataaagcactctgcacagcaaaggcaaatcaagaaaaaaaaaacagaactccttgggaatggatccacaaccaaaaaggcgtagaagcctggaatcattttaccgctgcagtggaaagccgaaaagaaacccgaggcttaaaaaaaaggaattttctattaaaaagttcaaaagaaacagaagaaaggttcaggagtagaaatttaaacgatacacgatatgcagcccgggtaatggccgaagcagtaaggttactgtatccaagtgggaacagagctgagaagggaggtgtgaaacgagtctttaccagacccggagccttaactgcagcattacggcatgcttggggggtagaaagcttaaaaaaaataaatggtaaaaggttaaacgacgacagacatcacgctctagacgcagcagtggtggcggcggtatcagaaaaagaaatacaaaaattgacaaaatcattccaaatatgcgaacaaaaaggtttagcgagacccatgcgagatgtacccatgccatgggaaggattccgacatcaattggaaacggcatatgcagatattcgagtagcacggccagaaagaagaagagcaagaggaaaaggacatgacgccactatacggcaactccgagaagaaaaagatggaccagtagtgtatgaaagaagagcaataagtgacttaaaactaacagatttagagagaattaaagatccagagagaaactcagccataataagcagcttaaggacgtggatagaaaagggtaaaccagcagactatccaccgcaatctccgaaaggagatgaaataaggaaaataagggttatgagtagaaataaaccggcggtatccgttcgaggaggaaccgctgataggggtgaaatgacaagggtggacgtatttacaaagatgggaaaaaaaggcaaaccagaatggttcctagtaccgatatataggcatcaagtaatagatcgaatccaatggcctcaaccaccaaaccaagcagcagcaaatggcaagagtgaaaaaaactggcctaccatgggactagaacatgaatttcgattttcattgtaccctagatcatatgtccaaatagtaaaaagagacggcgaaattatagaaggatatttcgcaggactggacagaacggtagcagcgtttagtcttctatccagttcagatccgacttcaatacaacgaggtataggagcaaagacattagaaagtatacggaaatacaacgtaaaccgatttggagatataagcatggtggaacaagaaacacgaacatggcatggagacgtatgcatcagcccggatcaaccggattccgcatga

SEQ ID NO: 4948 - RNA, 3147 nt, synthetic construct
  misc_feature 1..3147: note = Cas9 variant
  source 1..3147: mol_type = other RNA
atggtcgaaaaaatacttggtatagacctagggattagctcacttggatgggcagtagtagaatatgataaagataacgatgagaataataaaataatagactgtggagtaagactatttacagccgcggaaaccccaaaagaaaaggagtcgccaaataaagcacgacgtgatgccagaggtctaaggagagttataaagagacgtagagttagaatgaacacaataaaaaacttactaattacctataaattaatagacaaaaccctcttagatgaggaaatgggcatgtttcattcccaaagcaaccgagtggacgtatggaaactacgccacgatgcgctatatcacctcttgtcaggtgacgaactagctagagtcctaatccacatagcaaaacacagaggatacaagttcttaggtgacgacgaaagtgacgaagaaagtggtaaagttaaaaaagcaggagcagaactgaaaaaaaaattcttagaagccggatgccagagtgtaggtgaatggctttggaaagaaagaggactccaaggaaaaaaaaggaacaaatcaggagactatgaaatttccattccacgtgacttcctagtcgaagaaatacaaagaatatttgaaactcaacagaaattcggatctaccttcgcaacaagcgaattacaaaaagcctatactgacatagcattctacgtaaaaccaatgcaaagcattgaagacatggtaggatattgcaccttctacccaaaaataaaatctaaaaatcaagacggcgaaaaaagagcacccaaagcctcaccaagcgcagaacagtttgtgatattatcaaaaatcttttcaacaatagtgatagatgaaaataaacaagaaaaaaaattaatagaactaaaaagtatagaacagctgatacaaattgcccgttccaaagaaacactcaaatacaaacaactaaggaaagaactaaacttagcaaaagacatatcctttaaaagtataagtgatgaggaaaaaacatggatcaacctagtaggcaacgcaaagttcaaaaaaatcctaggactaaactatgaaacattccttaaaaacacagaaatatcagacgaaatcgccaaaatattaacttacgataaaacattcgaacaaaaagaaacaaaacttaaaaacctactagtaaacatcgactggatagacaataaccacatagcagaattagcaaaattaagcttctcacaattcaaccaactttccttaaaagctataaaaatcatatcaaaaataatgatagaaggatacgctagatatgacgaagcagtacaatacgcattcgaaaataatctactcccaaaaccttcacatgaaaaatcaatactattgccacccttaaaagaaacaaacatcgcaatattaaaccctacggtaatccgtgcatttgcacaattccgtcaagtagccaatgcgttagttagtaaatacggaagcttcgacaaagtacacttcgaactagctagagaagtcaataccaaagaagacagaaaaagatgggaaaaagacagagataaaaatgaaaaaatgcaccgacaaataacagaaaagctcgttgaagaaggggtaaaaccgtcatacaaaaatatactaaaaagtaaattaagaagtgaacaaaaagacacctgcccctactgccaaaaaaatctacattatcccatgatatttgaagatggctacgcagaaatagaccatattctacccttaagtcaatcccaggacgactcatacgtcaataaagttctagtccactcagcatgcaaccagaacaaaaaaaacagaacaccattcgaatggtttcaagatgaaaaaaaagattgggatacattcaagagttacatcttaatggaaagcacactgggagaaaaaaaacgcaactacctaatcaaagaaaatttttcagaccctcaatcacgtaaagaatttataagccgaaatctcaatgacacacgctacatgtctaaagcaataaagacctactgcgaaaaccattggaaactaagccatgacgacgacaaactccgcatacaagtacgaagtggaaaactaacaagcacactaaggcatcaatggggactagacaacaaaaacagagaaactcacacacatcacgcaatggatgcaattatgatagccttctcaactcaaggaatggtaaaaaaactcagtgattattttgcaaaaaaagaagcgaaagttgaaaaagataaaccagtactaataaccccaataaaacaattcaaagaagcagtagaacaagctactactttagaacgtcaagaaagtatacaaacaaaagctggagacacaataacactcaaccgactactaatatcacgacctcctcgtgcttccgttacaggagccgcacatgaacaaactgccaagccctaccctagaataaaaccaatcaaaaataaatataaaaggagaagaataccaatcgatgaagataaattcgaattatttaggaatgataaagtagcaagtggaaatgacaagaacttttacaacagcagcacaataccaagagtagatatatacaaaaaagacgataaatatcacgttgtcccaatatatctaagtgatatgaccaaagctgaagtaccaaacaaatcgctaggaacaaaccctgaaggcatggatgaaaaatacttctgtttctccgtctttaaaaatgacctaatagaattagaaactaaagcaactcccaaaaaaccatctaaaaaactcttaggttacttcaaacaactcaacggagctaacttcatactaaactcaattcataatggtataatcgacggcttcgtatgtagccccataacactatttaaacaacagaaagacatgtgcaaaaaatgtctccccgaagacagagccataggcaactgttcccaggaaacattagaattctgggaagcagaaaacataaaagtaccaaaaaaagattttgaatgcgaccaaggtatcaaatttgctattgctgttagaaaatacaccatagacccactaggatactatcatgaagtaaaaggcgaaaagttattaggaacaataccacagggggcaaaaaaacatccaaaacgacagaaatga

SEQ ID NO: 4949 - RNA, 3150 nt, synthetic construct
  misc_feature 1..3150: note = Cas9 variant
  source 1..3150: mol_type = other RNA
atgataaatgaaagattgacttttggcatagaccttggcattgggagctgcggatgggcagtcctaagacacgctgatgcagctggggagccaggagttatagaaggactgggctcatggtgtttcgatgtaccagaaacaagtaaagaaagaataccaactaatcaagtgagaagatcaaatcgattattaagacgggtaataaggagaaggagaaatcgaatggcagaaataagaaggctatttcacgcacagggattacttccgagtgcagatgaagatgcattaaaacgtccgagattagacccatgggagttaagggctcgcggactggaccagtgtttaagtgctgaagaatttgctgtggcactcggccatattgcaaggcatcgaggattcagatcatctgctaaacgtaaagctgcaaatacaagtggggaagactctaaaatgctatctgctctacttgttacgagagagaggactgctagatatcgaactgtaggggaaatgtttgcgagagatccagaatacagtgcgcgaagaaggaacagagacggtattttcgatagaactgtagcaagagatgatttaatacatgaagtaggaaaattatttgaggcacaaagagcaaggggaagtgcattcgctagccctgacttggaagctgattttaacgcaattgctttcagacaggctgaaatgcaagactcggaaagacttgttggaaactgtccctttgaaagagatgaaaaacgagctgctcgatgggccccatcatttgaaaggttcagattattaacgagattaataaacttgagaatagcaacagcagaaggagaacggagatttaccccagaggatttggcaagggtatcagccgaactaggagctacagcaaaattacctgtaagtagagtaagggcattaataggattactacctgatgaacgattcacaacaattagagtagaagatgaggatagagatattgtagcaagaacaggagaagcagcaccaggaacttggagactcagaaaaacattaggtgaagctctctgggcagagatgcaggcacgacctgatcaattagacgctatagcacacgttttaagtttcttcgaagctacagcaaaaataaggtccgaactggataggcttggcctgccagcagcagttattgaagcactcgatcgaggactggaagatggagcatttgctaaatttaagggagctggtcatatttcagctaaggcatgtcgtaacttactgcctcatttacaacaaggacatagatacgaccaggcatgtagactcgccggttatgatcatgccgccagtactctatcacatacagcacaagtagtttccaaggcaggatttaatgcgttagttacggaactaggagaatcaatcgctaatccaatagctagaaaagcattaacagaaggtttgaaacaaattagagctatgtgcgcaagatggggattacccggagcgatacacatcgaactagctagagaagtaggtaatagcatagagaaaagaagggaactagaaagtcaaagagaaacaacaacaaaaagaagacaaacagaaagagatgaaataagaggactgttagccttagaagatgtagatgatgatacattactcaggtatagactatggaaagaacaaggaggaaaatgtctctatacaggaaaagatatccacgtgagacaattaatagctacagataattctgtccaagttgatcatattttaccatggtccagattcggagatgatagctttaataataaaacactatgcttagcgagtgcaaaccaaagaaaaagaggacaaacaccatgggaatggtttagtttaacaggtacaccagaagcatgggaagttttcgcttcccgtgttgaaacaagtaaagatttaaggggatttaagaaaaggaatttgcttctcaaaaatgcagatgaagttgctcaacggtttagaagtagaaacttaaatgacacaagatatgccgctagattattagcagaagcggcaaaactgttctatccagcaggagataggcaagaaaaagatggacgtagaagagttttgacgagacctggaccattgacagcagctttaagacacgcctggggattagagtccttaaagaaagctgatggtaaacgtgtatccgatgataggcatcatgccttagatgcgctagctgtagcagccattagcgaaagagaagtacaaagattaacaaggagtttccaagaatgggaacaacaagggctagctcgaccactaaggcacgtggcaccaccatggcctggatttcggggagatgtactagctgcttacgctcaggcgttcgtcgcaagaccagaaagaagacgagctagaggaaaaggacatgatgcaagcatacgccaagtagtaggagaaggtccagaagcacaagtattcgagagacggggattggctgatctaaaagaagctgatctagacagagtaaaagatcctgagagaaatcaagctataatagaagcagttagagcatggatattagcaggaagaccagcagatgcaccaccaagatccccaaggggtgatgtcattgtgaaattaagaactgctcctgcgaagaaaatcaaaccggcagtaccagtccgaggaggaacggcagacaggggagacatggtacgtatagatgtatttacaaggccaaacagaaaaggcagagacgaatggtatctagttccaatatatccacatcaggtaatgaatagaaaagcatggccacacccgcctatgagaagtgtagtagcatacaaagatgaagcaggttggacagagataggagcggaacactcattcaggtttagcttgtatccgagatcatatgtacagttggtcaaaagtaacggagatgtaatagaaggatatttagtcagtatggacaggagtactggggcattcagagtgtttgtgcataataatccagctgagatggcaaaaggaataggtgcaaaaacattattaaatcttagaaaatttaacgtggacaggtttggcgtgaggacggaagtaaaaagtgaggtacgaacgtggcatggagaggtatgcacctcacctgtaccaccagactga

SEQ ID NO: 4950 - RNA, 3150 nt, synthetic construct
  misc_feature 1..3150: note = Cas9 variant
  source 1..3150: mol_type = other RNA
atgcaactatcaaaactaaactacattttaggcttagatctaggaatagcttcagtaggttggtctgtgatcgaaatagatgaaactgaaatgccaatacgattaatcgatgtaggagtaagaacatttgaacgagcagaagtacccaaaactggtgaatctctggcactagctaggcgattagcaagatctacaagaagacttataagaaggagagcatttaggctcttaaaagcaaaaaggctactaaagaatcatcaaatagtaagtgccgacgaattaagcaccctgccaaatcactgttgggaattaagagtaaaaggtctagacgaacgactcacatgtcaggaatgggcagcagtacttctccatttattaaaacacagagggtatttgagccaaagaaagtcggaagcacaaaatgcagacaaagaaatgggagctctactttccggagtagcaaacaaccacaaactactttcagaaaaccactaccgaacacccgcagaaatagccgtaaagaaatttgccttagaagagggacacatgagaaatcaaagaggagcttatactcatacatttaacagactcgacttattggcagaaatgcgtttactatttcaaactcagagagaactaggttcaccttacgcatccggagaactagaacaagaattttgcaaactactgatgtggcaaaaaccagcacttagtggcgacgcaatactaaaaatgctaggaaaatgtactctagaacccacagaatataaagcagctaaaaatacatatacagcagaaagattcgtatggctcactaaattaaacaatttaagaatcctagagaatggttcagaacgagcattaaatgcagatgaaagggcactattactaaaccaaccatacgaaaaagcaaaatttacgtatgaacaagcaaggaaacttttacagctaaatgaggcagcgagatttaatagcgttcgatatggaaaagaaaatgcagagaaaagcactttaatggaaatgaaagcctatcatgcaattcgtaaagcagtggaaacagcagactcatcagcctgggcaacactaaaaacacaaccacttcttttagacgaaataggaactgcattttcaatatataaaacagatgaagatataaaaacacaactacaaggcaaattagcagacaatgtaatagatgtcttactagaaaatttaaattttgataaatttatacaattatcattaaaagcactctacaaaatattaccccttatggaacaaggactacgctacgacgaagcatgttcacaaatttatggtgatcatttcggcaagaaagaacagaaaaatgatagactattaccccaaattcctgcagatgaaataagaaacccagttgtattacgaacgctatcacaagcccgaaaagtaataaatgccgtaataaggctctacggaagcccagcaagaatacacatagaaacagcaagagaactgggcaaatcctataaagacaggaaagaaatagagaaaagacaagaacaaaatcgagccgaaagggaaaaagcagtagacaaattcaaagaattatttcccaactttatcggagaaccaaaagccaaagacatcctaactatgcgtttatatgaacaacaaaacggacaatgcttatattcagggaaaagtctagatctacaccgtttattggaaaaaggttacgtagaaatagatcacgctctccctttttcaagaacatgggacgactcatttaacaataaagttctcgtattggctggtgaaaaccaaaacaaatctaaccaaacaccattcgaatggctaggtaaagatgaacaaaaatgggcactatttacagctagagtcaacagctgcagatttccgtattccaagaaacaacgaatactaacaaagaaattagacgatgaaggttttatacaaagaaacctaaacgatactagatacatagcaaggttcctcgtaaactttgttaatgacaatctacatttaaccggaaaaggaaaaagacgtgtgtttgcctcaaatggacaaataaccgccttcctgcgaggtagatggggactaacaaaagtgcgagaagaaagcgacagacatcacgcactagacgcagtagtggtagcatgtagtacagtttctatacagcagaaaatcactaggttcgtgaaatatcaagaaggtaacctacaaacagcagaaagaatagatcgagaaacaggagaaatcattccattgcattttcctgatccatgggcattctttagagaagaagttatgattagaatatttagtgaaatgccacaggaagacctagtaataaaactaccagatcgtccacaggcaaaccacgaatttgtacaaccactttttgtcagcagaatgcctactcgaaaaatgtcaggtcaaggccatatggaaacaatcaaatcggccaaaagactcgatgaaggtataagtgtgtcaaaagtaccattaacacaattaaaactaaaagacctagaaaatatggttaatcgcgatagagaaattgctctctatgaagcactcaaagcgagactcacagagtttaaagatgaccctgcgaaggcctttgcggaaccattctataagaaaggaggagtacaagtaaaatcagtccgagttgaacaggtccaaaagtccggagttgtagtcagaaacgggaatggcgtagcagataatgcatcaatggtcagagttgatgtctttataaaaggtggaaaatatttccttgtcccaatatacacgtggcaagttgcaaaaggtattctcccggacagagcagtaatagcatatacaccagagaacgaatgggaactaatggacgattcagcccaatttcaattttcaatctacccaaatgatttaatcaaattgactaccaagaaagccatctttttcggatattattcaggatttaacaggctaacaggcgcaattaacatcaaagaacacgatctccaaatatcaaaaggggacaaaggagttcatctcggtttaggcgtaaaactagcactaagccttgaaaaataccaagtcgatgaactaggcaaaaacataagaccatgcagacccacacaaaggcaaaacgtaagatga

SEQ ID NO: 4951 - RNA, 3153 nt, synthetic construct
  misc_feature 1..3153: note = Cas9 variant
  source 1..3153: mol_type = other RNA
atgagttcctatagattttcatttgacttaggaaccaattcaatcggatgggctgtattcgagctggaccctaaaacgcgaccagtagctttagcagattgtggcgtccgaatctttccagacggaagaaacccaaaagataaacagtccttggcagtagcaagaagagaggcccgagccgttagacgacgaagagatcgttatttaaaaagaaggtcagaattaatggaaagattagtagcaaaaggactaatgccagaaagtagagacgatcaaaaagcattagaaggactcgatccctatgcactacgagctgcaggattagacgacgcattaccaccacaccactttggcagagccttatttcatctaaatcaaagaagaggatttaaatctaatagaaaaaccgataggggagaaaacagtgaaacaggaataacaaaaataggaatgaagaaattacatgaggctctactcagtgaaggatgtaggacactcggagaattacaacataggcatcacgaagctaaccaaacccctgcaatggacacaaatcccaaatcagttagaagtaaattacgcggtgagggggcaaaagctgtatatgatttctatccatcaagggacgcagtagaagatgaatttaacaaactatgggacagtcagaaaaggtttcacccagatttgctaacagactcagcacgagatgctattagagatgcaatattctatcaaagaaaattaaaaacacctgacgctggaagatgctcatttaatcctgcggaagagagagtagcaagagcaatgcccatagcacaacacttccgaatactacaatttgtaggcgatctgagattaatagataacgatctagtacgacatccgttgaacaatgatcaaaagaaagctctctacagagatttactagcaaaaggtaaattgacatttaaagcaatgaggaaaacaataggtatcggctcagagtacgccttttctcatgaaagtgaaaaacaatctgagtttagaggagatgaaacagcagcaagactggctggacctaaatactttggaccgaagtggagagaactatccttcaacgaccaatctgaaatagtagacaggttattacatgaagaaaacgaagaaactttgatacaatatcttcaagatcgatttggatttgatcatgatcgatgcgaagtaatagctgacgcacccttgcccgacggacacaccagactcggaaaaactgctctagaaacattagtagaaataatgagagacgatcacttgccctatgatcaagcatgcaccaaagcaggatacgaacatgcactaccacctgatggagtaatacttgatgatctaccatattatggcatcgcattagaacgacacgtagcatttggagatggaaaaagtgagaatccagagaagaggtatggaaagatagcaaatcctacagtacacatagctttaaaccaactacgtaaggtaatcaatgctttgattgcaagatatggacaccctgatcaagtggtaatggaaattgccagagatttaaaacagtctaaagcaaaaagagatgatataagcaaagaacagaagaaaaaccaagaccgaaatgatcagcgccgcaagaaacttcaagaggcccatatagcagttaacgcagaaaatatgttacgtatgagactttgggaagaactggacgaggataacgctgcagcaagagcttgtccatttactggtgaaacaatctcaatggcacgattattttcacccgaagtggaaatagaacatattttacctttttcacgatcactggataacagtccggcaaataaaactctatgcatggtatgggcaaacagagcaaaaggtaatcgcactccatgggaagcatttggaagagatagagaaccagggtttgattggcctgaaattgcggcacgagcagctagattacccaaaaacaaaagttggagatttggcccagatgctatggaacgattggagagagaaggagactttctcgataggcagctaacagacacccaatatttgtcaagaatagcgagagaatacgtaacaaaaatatgtgatccaaatcaagtttgggtcacaccaggaagattaacagcctggttaagaaggaactggggattaaatggaatcttaccaactggaaatgcaactaaaaatagggacgatcacagacaccacgcaatagatgccatagtagtggggttaacggatagaggaatactaaatagagtaagcaggtcagcagccttagccgaagcagaagatttagacagaagcatcgcagaaatgccagatccatttgacggattccgggataatatacgacacatattagaacaaattatcgttagccataaacccgatgcaggatttgtacctggacatcccaagggaaatacgacaccaggagcactccataatgatacagcttatggaattataaaaacagatgccaaaggtatgtcagaagttgtcacaagaaaagacgttttgtctttcaaagggacaaaggaaatagaaagtataagagacgcagcaacgcgacaaagcctattagatgcagtcgcaggagtccccagcggtttagcatttaaggaagcattaagggactggtcagtaagaacaggtacaaaacgagttcgagtaacattcaatatgtcagtgataccaatacaggatcgagatggaaaagcgtataaaggatacaaaggagatggcaacctatgcgcagaaatttatgaacgacctgacggaaaatggggtgacgagataatctcaagatttgatgcagttcaaccgggctttacaccccaatggcaacgagatcaccctgcggcacatcgcgtaatgagactgttcagggatgacatgataatggcggagatagatggagttatgacggtatgtaggatagtaaaaatgagtcctggaaaagtagtattcacaccacatcacgaagcaaataccgatagtaggaatcgagacaaagatgaccctttttcattccatacctgctccggagaaagtttacgcaaaagaaaagcacaaaaactatttgtagatccactcggaaagataagaggttatagagcaaaagaagggtga

SEQ ID NO: 4952 - RNA, 3153 nt, synthetic construct
  misc_feature 1..3153: note = Cas9 variant
  source 1..3153: mol_type = other RNA
atgggtgaaaatatgatagacgaatcacttacattcggtatagatttaggtataggaagttgtggttgggcggtactgcgtcgaccatcagcattcgggcgaaaaggggtaatcgaaggaatgggatcttggtgctttgatgtcccagaaactagcaaagaaaggacaccaacgaaccaaatacgaagatcaaatcggttattaagacgggtaataagaagaagaagaaatcgtatggcagcaatacgaaggctattacacgctgccggattattaccgagtacagattcagatgctttaaagagaccaggtcacgatccatgggaattaagagcaagaggactggataaacctttaaaacctgtcgaatttgcagtagtactagggcacatcgcaaaacgaagaggctttaaatcggctgcgaaaagaaaagcaacaaatataagttcagacgataagaaaatgttaacagcacttgaagctacaagagagagactgggaagatataggacagtcggtgaaatgtttgcaagggatccagattttgccagcaggcgaagaaacagagaaggtaaatacgacagaacaacagcacgagatgatctcgaacacgaggtgcatgcactatttgcagcacaacgaagattagggcagggattcgcgagcccagaactcgaagaagcattcacagcctcagcatttcatcaacgtccgatgcaagattcagagcgattagtaggattttgtccatttgaaagaacagagaaaagagcagcaaaattgactccctcgtttgaaagattcagacttcttgcaagattattaaacttaagaataactacaccagacggagaaagacccctaactgtagatgaaatagcgctagtaaccagggatctcggtaaaacagcaaaactaagtataaaacgagtgagaactttaataggcttagaagacaatcaacgatttactacaataagaccagaagatgaagatcgagatatcgtagcgagaacgggtggggcgatgacgggaacagctaccctaagaaaggctttaggtgaagcattgtggaccgacatgcaggaacggccagaacaattggacgcaattgttcaagtgctatcattcttcgaagccaatgaaacaataaccgaaaaattgcgagagataggattaactttggctgtactagacgttttactcactgctctcgatgctggcgtgttcgcaaaattcaaaggtgctgcacatatatcaactaaagctgccaggaacctacttccacacttagagcaaggaagacgatatgatgaggcatgtacaatggccgggtatgaccatgcagcatctaggttaagccatcacggtcaaatcgtagccaaaacacaatttaacgcgctagtaacagaaataggagaaagtattgctaacccaattgcaagaaaagcactaattgaaggattaaaacaaatatgggctatgagaaatcattggggattacctggatcaatacacgtcgaattagctagagacgtaggcaattccatagaaaaacgacgagaaatagaaaaacacatagagaaaaacacagcattaagagccagagaaagaagagaagtacatgacttattagacttagaagatgtaaatggagatacactattaagatatagattgtggaaagaacaaggaggaaaatgcctttacaccggtaaagcaatacatatacgacaaatagcagctacagacaattctgtacaagtggatcacattctcccatggagtaggttcggtgatgattccttcaacaataagactctctgtttagcatccgccaatcaacagaaaaagcgaagtacaccttatgaatggttatcaggacaaaccggagacgcatggaatgcctttgtccaacgaatagagaccaataaagagctaaggggttttaagaaaaggaactatctattaaagaatgcaaaagaggctgaagaaaaattcagatcccgaaacctaaacgacacgcgatatgcagcaagactattcgcagaagcagttaaattattatatgcgtttggggaaagacaagaaaaaggtggaaatagacgagtatttacaaggccaggagcgttgacagcagcattaagacaagcatggggtgtagagtctctgaagaaacaagatggaaaaagaataaacgatgacagacatcacgcattagacgccctaactgttgcagcagtcgacgaagcagaaatacaaaggctaaccaaatcatttcacgaatgggaacaacaaggattaggaagaccactacgacgtgtagaacccccatgggagtctttcagggcagatgtagaagccacgtacccagaagtctttgttgcaaggcccgaaagaagacgagcaagaggggaaggtcacgcagctacaatacgacaagtaaaagaacgagaatgtactccaatagtatttgaacgtaaagctgttagcagcctgaaagaagctgatttagaacgtataaaagacggagaaaggaatgaagcaatagtcgaagcaatccgaagttggattgcaacaggaagaccagctgatgcaccaccgagaagtcccagaggtgacataataactaaaataagattagccacaactattaaagcagccgtaccggtacgcgggggaacagccggaaggggtgaaatggttcgcgcagacgtattcagtaaaccaaatcgacgaggaaaagacgaatggtacctagtacccgtatacccacatcaaattatgaatagaaaagcctggccgaaaccccctatgagatcgattgtagcaaacaaagatgaagatgaatggacagaagtaggtcccgagcaccagttccgatttagtctttacccaagatcaaacatagaaataataagaccatcaggagaagtcatagagggttattttgttgggttgcatagaaatactggtgcgctaacaatatctgcacataatgatccaaaaagcatacatagtggaataggtaccaaaacgctgttagcaattagcaaataccaagtggatcgctttggaagaaagtcgccagtccgcaaagaagttagaacttggcatggtgaagcatgtataagtcccacaccgccaggttga

SEQ ID NO: 4953 - RNA, 3153 nt, synthetic construct
  misc_feature 1..3153: note = Cas9 variant
  source 1..3153: mol_type = other RNA
atgaaaatattaggttttgacataggtatagcaagcataggttgggcatttgtggaaaacggagaactaaaagattgtggagtaagaatatttacaaaagcagaaaatccgaaaacaggcgactcattagcaatgcctagaagagaagcgagaagcgtaagacgacgcttagcacggcgaaaaggacgattagaaacattaaaaagactactagcaaaagaatgggacttgtgctatgaagattatatagcagcggacggagaactacctaaagcctttatgggtaaaaatttaaacaacccatatgtattaagatatgaggcacttcaaagattactaagcaaagaagaattagtgagagtagtactccatatagccaaacacagaggatacggaaataaaaacgctaaaattacaaaaagtgaagaaagcaaaagagaacaaggaaaaatcctctcagcactcgccactaatgcatcagcaatagcaagatacagaaccgtaggggaatatttttataaagagttctgcgaagttataaagaaccctcaaggtttatcaacaaatgaacattatacacaatccaaagtacgggtattaaagccaatacggaacaagggaggagaatataccaattgcatattacaagaagacttacaacgcgaacttcgatgtatctttgaataccaaaaaggttttggattcccaataacacaggagttccaggacaagatactcaaaatagcattctatcaaagaccactaaaagacttttcacatttagtaggaaaatgcacattctatccagacgagttcagagctttaaaatgctccctatcagccgtagagttcataacattaagtaaaacaatcaacgtactgacatacatctccaaagaatcaggagaagtatactcaaaaggtcaatacgaacaaatgttagattcagtattcaaagcagtatgcgaaaaaggatccctatccttcgcccaattacgaaagatattacacatagatgaaagaataaggttcaaagaagtagattatatggcacgcaaaagcaaaaatacaagtggggacagtacacacaaacagaaaacatcaaatcccgaaacaaagaaatttatagaacacaagaatttaaagaaattttgtgaaatattaagcgaaatcgccgaagatagagccctagcggattcaatagcaagagacatgacgcttattaaagacgaagaaaaacttgcccaaaaattacacggatacggtaaattctcacaagaacaaataacccaactaagtgccttaaatttcagtcaccacataaatctatcattaaaagcattatcagaaattttaccctttatgcgcgaaggaatgcgatatgacgaagcatgtaaacttgccggcttaaaagcacgacacaatgacaagaaatcaaaatttctaccaccattttgtgaaagcatttatgcagacgaattaacaaacccagtagtgcacagagctatcgcagaatacaggaaaattttaaacgcactaatagcgaaatacgggtcagtacacaaaatacatattgaactcacaagagacgttggcaaaaatttccaagaaagagaaaaatataagaaagaaatagaatcaaactataaagccagagtgcaagcaatgcaagaatgtgaaaaactaggactaaccctctctgaaggaaatatactcaaactaagattattccgagaacaaaacgaaatatgcgtctactcaggtaggaaaataactctagcaaatctaaaagaacaaggtgctttagaaatagaccacatactaccctattcacgttcaagcgacgattcttatatgaacaaagtgctagtctttacaaacgaaaaccaaaataaaggtaacaaaactccatatgaagcattcggaggagattcccaaaaatggggagaaatagaaagcctagcattaagaagtggatatcccaaaaagaaagccaaaagaatactagataaaggattcggcgatcgagaagcaggattcaaatcacgtaacatagtagatagcggatatatcgccagactaatagccaattatacaaaagaatatctgaaatttttaccattagattcccacgaaaatacagcacttatagccggtgaaaaagattcaaaaatacatgtcgaagcagtaaaaggcatgctcaccgcaactatgagacacttttggggtttaggaagtaaaaacagatatgaacatacgcaccatgcagtggatgcaataataatagcctacataaatgccgccatgatacaaagattttcacaattcagacagaaccaggagagcttaaaagcacgattctacgccaaagaactagcgaaagaagagttcaaaacacaaagagcattctttgaaccttttcgcgggtttagagaacaagtcctagcaaaagtaggtcaaatatttgtatcaaggcctccaagaaaacgcgcaagaggggccttacacgaagaaacgttttactcaatagacgacaagaaacttagcgaaacgtatggaggcaaagaaggtgttcaacgtgctctgagcttaggaaaaataagacaaattggtacaaaaatagtcgcaaacggacctatggtacgggtagacatttttaaacataaacaatcaaggaggttttatgcagtaccaatatatacaatggacttcgcattaggcatcctccccaacaaagccgtagtaagcgggaaagacaccaaaagcaaagtaataaaagactggctagaaatggatagttgctatgagttctgcttcagtttattcaaagacgacctcatagaagttcaaaaatcagatatggaaaaacccgaactagcttacttcgtaagcctagatgcttccgacggaagaatcaaggttcgacaccactgtaacgatataacaaaaattaacgaaaatcaaaagaaactgttttctgaagcgatagaaaaagaagtcgttggacggggaagcatacaaaacttaaaagttttcaagaaatataaagtatcaccactcggagaaattaaagaagctaaatatgaacctcgacaaccaatagcactcaaaacctcaccaaagaaacacaggaaacaaaataacgcgcaatga

SEQ ID NO: 4954 - RNA, 3156 nt, synthetic construct
  misc_feature 1..3156: note = Cas9 variant
  source 1..3156: mol_type = other RNA
atgaacaattacatactaggattagacattggcataacctctgttggatacggaatagtcgatagcgacacaagagaaattaaagatgctggagtaagactattcccagaagctaacgttgataataacgaaggccgtcgatccaaacgaggagcacggagacttaaacgcagaagaatccacaggctagacagagtaaaacacttactagcagaatatgacctgttagacctaacaaatattccaaaatcaacaaacccataccaaactagggtaaaaggattaaacgaaaaattaagcaaagacgaactcgtaatcgcattattacatatagcaaaaagaaggggcattcataatgtaaacgtcatgatggacgacaatgactcaggaaacgagctcagcacaaaagaccaactgaagaaaaatgcaaaagcactgtctgacaaatacgtatgtgaacttcaattagaaagattcgaacaagattacaaagtaagaggagagaaaaaccgatttaaaactgaggacttcgtccgggaagcaagaaaacttctagaaacacaaagcaaattcttcgaaatagaccaaacatttattatgaggtatatagaattaatagaaacaagacgagagtacttcgaaggaccaggaaaaggctcacccttcggttgggaaggtaacatcaagaaatggtttgaacaaatgatgggacactgcacttactttcccgaagaactccgaagcgtaaaatacagctacagcgcagaactgttcaacgcattgaatgatctaaacaatctagtaataaccagagacgaggacgcaaaattaaactatggtgaaaaatttcaaataatcgaaaacgtgtttaaacaaaagaaaacacccaatctaaaacaaatagcaatcgaaattggagtccacgaaacagaaataaaaggctatagagtaaataaaagcggtaaaccagagttcactcaattcaaactgtaccacgatctgaaaaatatatttaaagatccaaaatacctaaacgatatacaattaatggacaatatagcagaaataataactatataccaagacgccgaatctataataaaagaactgaaccaactaccagaattattatcagaacgagaaaaagagaaaatatcagcattatctggctactctggaacacaccgactatccctaaaatgtataaacctactattagacgacctctgggaatcatcactcaaccaaatggaattatttaccaaactcaatctaaaaccaaagaaaatagacttatctcaacaacataaaataccatcgaagctagtagacgatttcattttaagtcctgttgtcaaacgagcatttatacaatcgatacaggtcgtaaacgcaataatagataaatacggactaccagaagacataataatcgaactagctagagaaaacaactcagacgacagacgaaaatttcttaatcaactacaaaaacaaaacgaagaaactagaaaacaagtagaaaaagtattacgcgaatatggaaatgacaatgcaaaacgaatcgtacagaaaataaaacttcacaatatgcaagagggcaaatgtttatactcacttaaagatatacccctagaagacttactaagaaatccacaccattatgaggttgaccacataatacctagaagcgtagccttcgataatagcatgcacaataaagtcttagttcgcgccgatgaaaactcaaagaaaggaaaccgcacaccataccaatacctcaactcatcagaatcaagcctatcctataatgaatttaaacaacatatcctaaaccttagcaaaaccaaagaccggattacaaagaagaaaagagaatacctcctagaagaacgagacataaacaaattcgatgtacaaaaagaatttataaatagaaacctcgtcgacacaaggtacgcaacaagagaattaactagcttactcaaagcatatttctcagccaataacttagacgtaaaagtaaaaacaataaatggttcattcacaaactacctacgaaaagtgtggaaatttgacaaagatagaaataaaggatataaacatcacgcagaggatgcactaataatcgcgaacgcagactttctttttaaacataacaaaaagctaagaaacatcaataaggtattagacgcaccatccaaagaagtcgacaagaaaagagttacagtacaaagcgaagacgagtataaccaaatattcgaagacacccaaaaagcacaagccataaagaaattcgaaataagaaaattctcacatcgtgttgacaagaaaccaaatagacaactaattaatgataccctatattcaacacgaaacatagacggaatagagtacgtagttgaatccatcaaagacatatattcagtaaataacgacaaagtaaaaaccaaatttaagaaagaccctcatagattactaatgtatagaaatgatccacaaacctttgaaaaatttgagaaagtatttaaacaatacgaaagcgagaaaaatccattcgcaaaatattacgaagaaacaggagagaaaatacgaaaattcagtaaaacaggccaagggccttacataaacaaaataaaatacctgcgagaacggttaggcagacactgtgatgttacaaacaaatatataaatagcagaaataaaatcgttcaactaaaaatctactcataccgattcgatatatatcaatatggaaacaattacaaaatgataacaatctcctacatagacttagaacagaaaagtaactactactatatatctagagaaaaatacgaacagaaaaagaaagacaaacaaatagacgactcatacaaattcatcggatcattctataaaaacgatatcatcaattacaacggagaaatgtaccgagtaattggtgttaacgactcagagaaaaacaaaatacaactagacatgattgacatatctatcaaagactacatggaactcaataatataaagaaaactggagtaatatacaaaacaataggaaaatcaacaactcacattgaaaaatacactactgacatattaggaaatctatacaaagctgcacccccgaagaaaccccaactaattttcaaatga

SEQ ID NO: 4955 - RNA, 3159 nt, synthetic construct
  misc_feature 1..3159: note = Cas9 variant
  source 1..3159: mol_type = other RNA
atggaaaataaaaatctacattatatactaggtttagatttgggaatcgcaagtgtaggatgggctgtagtagaaatagacgaaaaagagaaccccttaagactaatcgatgtaggcgtaagaaccttcgaacgagcagaaacacaaaaaggagagagcttagctttaagcagacgatccgctcgaagcgcacgccggttaacacaaaggagagtagctcggttaaagaaagcaaaacgcttactcaaaagtgaaaatattttgttaagcaccgatgaaaggctgccacatcaagtgtggcaattacgagtagaaggactcgacagaaaactagaaagacaggaatgggcagcggtgctgctccatctcataaaacaccgtggctatctatcgcagagaaagaatgaatcaaaaagtgaaaataaagaactaggcgcgctactctctggtgtagcaagcaatcatgaattattacaacaggcaacctatcgaacaccggcagagctagcagtaaagaaatttgaagtagaagaaggacatattaggaaccaacaaggcgcatatacacatacattctcaagattagacttactagcagaaatggaactactttttagccgtcaacaacacttcggaaatccatttgcatcagaaaaattattagaaaatttaacggcattattgatgtggcaaaaaccagcgcttagtggagaagatatattaaaaatgctaggtaaatgtacctttgaagatgaatacaaagcagctaaaaatacctatacggcagaaagatttgtatggatcaccaaacttaataatctaagaatacaagaaaatggattagaaagagcactcagtgataatgagagactaatgttgatcgagcagccttacgaaaaagctaaattaacatatgcccaagtacgttcaatacttaacctgtcagacgatgctatatttaagggagtcaggtattctggggaagataagaaggctatagagacaaaaaccaccttaatggaaatgaaagcatatcaccaaataaggaaagtactcgaaggaaataacttaaaggcagaatgggtggcactaaaagcaaatcccaccctactcgatgaaataggtacagcatttagtttatataaaacagatgaagatataagtgcctatctagcaggcaaattatctcaaccagtcctaaacgcactattagaaaatctttcatttgacaaatttatacaattatcgttaaaggctttatataaacttctaccactgatgcaacagggcttgagatacgatgaggcttgtagagaaatatatggggaccactatggtaagaaaactgaagaaacgcatcatttcctaccacaaataccagccgatgaaatacgaaacccagtagtattacgaaccttaacccaagcgcgaaaagttatcaatggagtcgtcagattatatggaagcccagccagaatacatattgaaactggccgcgaagttggaaaaagctacaaagacagacatgaactcaagaaaagacaagaagaaaataggaaacaaagagagaaaacaatttcagaaataaaaacattatttcctaatttctctggtgaaccaaaaggaaaagacatcttaaaaatgagactatattaccaacaaaatgcaaagtgtttatattctggcaaaccactagaattacatagactattcgaacaaaaatatgttgaagtagatcacgcactacccctatcacggacatgggatgatagctttaataacaaagtgctagtattagctaatgaaaaccaaaacaaagggaatctaactccatttgaatggctagatggtaaaaacaattctgaaagatggagaacattcaaagccctagtagaaacatcagcattcccttatgcaaagaaacaaagaatactcagtcaaaaattggatgaaaaaggatttatagaaagaaatctcaatgatacaagatatgtcgcacgattcctatgtaattttatagcagataatatgcacttaacgggagagggaaaacgaaaagtatttgcatcgaacggacaaataaccgctcttttgcgccgacgatggggactcgcgaaaagcagggaagacaatgaccgacatcatgcactcgacgcagtattagtagcgtgtagtactgtagcaatgcaacagaaaattacacgattcgtgagatttaaagcaggagatgtatttacaggagaacgcatagatagagaaaccggcgaaataatcccactacatttcccaacaccctggcaattctttaaacaggaagtagaaataagaatattcagcgacaatcctaaattggaactagagaaccgattacccgaccgcccccaagcaaatcacgagttcgtacaaccgctattcgtcagtaggatgcctacaagaaaaatgaccggtcaaggccacatggaaactgttaaatcagccaaaagattaaacgaaggaatatcgatgattaaaatgccattaactaaactcaaactcaaagaccttgaactaatggtaaatagagaaagagaaaaagatttatatgacgcgttaaaaaccagattagaagcattcaacgatgacccggcaaaagcgttcgcagaaccatttatgaagaaaggaggtgcaattgttaaatctgtacgcgtagaacaagtacagaaaagtggagtgttagtacgacaaggaaatggagtcgcagacaatgctagtatggtaagagtagacgtatttaccaaagacggaaaatactttttagtcccaatatatacgtggcaagtggcaaaaggaatactcccaaacaaagcagttatacaaggcaaagatgaagaagattgggaagacatagacgatgcaacatttcaattctcacttcacccgaacgacctgatctccgtaaaaacaaagaaagatgaatttctaggatatttcaatggcctcaacagacacacaggaggaataaatataagaacacatgacctcgaaaaatcaaaaggaaaacagggcatatttgaaggtataggggtaaaaatagcactcagctttgaaaaatatcaaatagatgaactagggaaaaatataagactatgtaaaccgtctaagagacaaccagtaaggtga

SEQ ID NO: 4956 - RNA, 3159 nt, synthetic construct
  misc_feature 1..3159: note = Cas9 variant
  source 1..3159: mol_type = other RNA
atgaaaaatacgagtctaaactatgtcctaggcttagatttaggcatatcatcagttgggtgggcagtagtagaaatagatgaaaaagaaaacccattatctttaatagacgttggtgtaagaacttttgaacgtgctgaaactcaaaaaggcgaaagtttagcattagccaggagattagcgagatccgcaagacgcctaacacaacgcagggttgcaagactcaagaaagccaaaagacttttaaaaagtgaaaacatactcctaagtacagacgaatgcctacctcaccaagtttggcaattaagagtagaaggacttgaaagaaaactagaaagacaagaatgggcagcagtattactacatttaattaaacacagaggttatcttagccaaaggaaaaatgaatctaaatcagaaaataaagaattaggagcacttttatcaggcgtagcaaataaccataaactgctacaacagactacgtacagaacaccagcagaattagccgtgaagaaatttgaagtagaagaaggacatataaggaatcaacaaggaagttatacacatacattcagtcgactggacctattaagcgaaatggaattattattttctagacaacaacactttggtaaccctttcacatcagaaaaacttcttgaaaacttaacggcattattaatgtggcagaaaccagcactcagtggagatgcaatattaaaaatgttagggaaatgtacattcgagaacgaatacaaagcagccaaacatacatatagtgctgaaagattcatatggatcacaaaactcaacaatctacgaatacaagaaaatggtttggagagggcattaaatgataacgaaagattggctttaatgaaacaaccatatgaaaaagctaaattaacttatgcacaagtaagatcgatcttaaatttaagtgacgaagctatattcaagggactaagatactcaggagaagataagaaaacatccgaaacaaaaacagtactaatggaaatgaaagcatatcatcaaatacgactagcactagagaaaaatgatttaaaaacagaatgggcagaactaaaagtaaacagctccttactcgacgaaataggtacagcattcagcttatacaaaacggatgaagatatatcaacctgccttgccggtaaactatcacagccagtattgaatgcactccttgaaaatctcaatttcgacaaattcatccaactatctcttaaagccctacacaaaattttacctttaatgcaacaaggtcttagatatgacgaagcatgtgcagaaatatatggagatcactatggaaagaaaactgaagaaaatcatcttctacttccacagataccagctgatgaaattaggaatcctgttgttttacgaactctcacacaagcacgtaaagtaatcaatggtgtcgtgcgactttatagcagcccagctagaatacatatagaaacaggtagagaagtaggaaaaagttaccaagaccgtagagaattagaaaaacgccaagaagaaaacagaaagcagagagaaaaagctataagcgagataaaaacgttatttccaaactttagtggtgaaccgaaagctaaagatatattaaagatgcgtttgtactatcaacaaaatgcaaaatgcctgtactcagggaaaccattagaattacacagactgctcgaacaaggatatgtagaaatagaccatgcactaccgttttcgagaacatgggatgattcattcaacaacaaagtattagtactggctaatgaaaaccaaaataaaggcaacctaacaccctttgaatggttggacggcaagaacaattctgaaagatggaaggcattcaaggctttggtagaaactagcgcttttccctatacaaagaaacaaagaatattaagtcagaaacttgacgaaaaaggctttatagaaaggaatttgaatgatacaaggtatgtagcgcgatttttatgcaactttatcgcggacaatatgcacctcacaggagaaggaaaacgtaaagtatttgcctcaaacggacaaattacagcgttattacgcggcagatggggccttgctaaatcaagagaagacaatgaccgccaccacgcattagatgcggtagtagtagcatgctcaaccgtatcaatgcagcagaaaataacaagatttgtacgttttgaagaaggaaatgtattcaccggtgagaggatcgacagagagacaggggaaataatcccacttcatttcccagcaccatggaaattctttagagaagaagttgaaatcagaatttttagcgataacccaaaactcgaattagagaacaggttgatagcaagaccgcaagccaatcacgaatttgttcaaccgttatttgtatcaaggatgcccactaggaaaatgactggacaaggtcatatggagacaattaaatcagcaaaaagactaaatgaaggattatcagtaataaaaatgttactcacaaaactaagactaaaggatttagaatcaatggtaaatagagaaagagaaaaagaattatacgaggctctgaaagcaagactagaggcttttaacgatgaaccggcaaaagcattcgcagaaccattcatgaagaaaggcggtgccatagtgaaaagcgtaagagttgaacaagtccaaaaatctggagtacttgtaagggacggaaacggagtagcagacaatgcgagtatggtaagagtagatgtcttcaccaaaggcggtaaatacttccttgtcccaatatatacgtggcaagtagctaaagggattctaccaaataaagcggtcatccaagggaaaaacgaagaagattgggaagtgatggacgatgcaacatttcgttttagcctacaccaaaatgacttagtaaaacttgttacaaagaagaaaactatatttggatactttaacggactgaatcgagctacaggcaacatagatataaaagaacatgacctagagaaaagtaaagtaaaagacggaatacaccaaagtataggaataaaactagcgcttagctttgaaaaataccaggtagatgaactaggtaaaaacataagattgtgtaaatcatctaaaagacaagcagtaaggtga

SEQ ID NO: 4957 - RNA, 3159 nt, synthetic construct
  misc_feature 1..3159: note = Cas9 variant
  source 1..3159: mol_type = other RNA
atgataggtgaacatgtcagaggaggatgtttattcgatgaccattggacaccaaactggggagcatttcgattacctaatacagtacgaacattcacgaaagcagaaaatccgaaagacggaagcagcttagcagaacctaggagacaagcaagaggactcaggagaagattaagaagaaaaacccaaagactagaagatttacgaagattgttggctaaagaaggagtactgtctctcagcgacctagaaacgttattcagagaaactccagcaaaagatccttaccaacttcgggccgaaggattagacagacctttgtcattccccgaatgggtcagagttctatatcatatcacgaaacatagaggattccaaagtaatagaagaaaccccgtagaagatggacaagagagatctagacaagaagaagaaggaaaattattaagtggggtcggtgaaaatgaaagattattaagagaaggaggttataggacagcaggagaaatgctagctagagacccaaaatttcaagatcatagaagaaatcgagcaggagattacagtcatactttatcacgcagcttattattagaagaagcaagacgattgtttcaaagtcagagaacattaggaaatccacacgcctcctcaaatcttgaagaagcctttctgcacttagtagcttttcaaaatccttttgcatcaggagaagacataagaaataaagcaggtcattgcagcctagaaccggatcaaataagagcaccacgcagaagtgcaagcgcggaaacatttatgttactacagaaaaccggaaatcttagactaatccatagacgtacaggagaagaaagacctttaacagataaagaacgggaacaaatacacttactagcttggaaacaagagaaagttacgcataaaacattgagacgccatctcgagatacccgaagaatggttgtttacaggcctcccttaccatagaagtggtgacaaagcagaagaaaaactgttcgtacatttagctggtattcatgaaatcaggaaagcgttagacaaaggaccagatcccgcggtttgggacacgttgaggtctcgaagggatctcttagattccattgctgacactttaacattttataaaaacgaagacgaaatactaccgagattagaaagcctcggactatcaccagaaaacgcaagagcattagcaccacttagcttcagtgggacagcacacctgagtctaagcgccttaggaaaattattaccacatttagaagaaggcaaatcatacacacaagctcgggcagatgctggatatgcggcacctccaccagatagacaccctaaattacctccattagaagaagcagactggagaaatcctgtagtattcagggctcttactcaaactagaaaagttgtaaatgcattggttcgaagatacggtccaccgtggtgtatacatctggaaactgctagagaactgagtcaacccgcaaaagttcgacgaagaatagaaacagaacaacaagctaatgaaaagaagaaacaacaagcagaaagggaatttttagatatagtaggtaccgctcctggtccaggtgatttgcttaaaatgcgactatggcgtgaacaaggaggattctgcccgtactgtgaggaatacctaaatcccacaagactcgcggaaccaggatatgcagagatggaccatattctaccatatagcagaagtcttgataacgggtggcataatagagttttagtccacggaaaagataatcgagataaaggtaatcgtacgccctttgaggcattcgggggtgacacagcaaggtgggacagattagtagcatgggtacaagcgtcgcacttatcagcaccaaagaaaaggaacttgttacgagaagattttggagaagaagctgaacgtgaattaaaagatagaaatttaactgatacgcgattcataacgaaaactgcagccacattgctcagagacagattaacgtttcatccggaagcgccaaaagacccagtaatgacacttaatggaagattaacagcatttctaagaaaacaatggggtctacataaaaatcgcaaaaatggagaccttcaccatgctttagacgcagcagtactcgccgtcgcatctcgaagttttgtttacagactatcatcacataatgcagcatggggtgaactaccaagaggaagagaagccgagaatggattcagtctcccatatcccgcatttagatcagaagtattagcaagattatgtcctacaagagaagaaatacttttaagattagatcaaggaggtgttggatacgatgaagcgttcagaaatggtctacggcccgtcttcgtctctagagcaccaagtcgaagacttagaggaaaagcacacatggaaacactacgctcaccaaaatggaaagaccatccagaaggcccaagaacagcatcaagaataccacttaaagacttaaacctagaaaaactagaaagaatggtaggaaaagatcgagacagaaaactatacgaggcattgagggaacgattagcagcattcggaggcaatggaaagaaagcctttgtggctccctttagaaaaccctgcagatccggagaaggaccactcgtacgaagtctaaggatatttgatagtggatacagcggagtagaacttcgagatggtggagaagtatacgcagtcgctgaccacgaaagtatggtaagagttgacgtctacgcgaagaaaaaccgcttttatctagtgcctgtatatgtagccgacgtagcgcggggtatagttaaaaatagagcaatcgtagcacacaaatcagaagaggaatgggacctagtagatggaagttttgattttagatttagcttatttcccggagatctagtagaaattgaaaagaaagatggagcgtacctcggatattataaatcatgtcacagaggagatggtcgacttttattggatcgacacgaccgtatgcctcgagaatccgattgtggcacattctacgtatcaactagaaaagatgtactaagtatgagtaaatatcaagtagatccactaggagaaataaggttagttggaagtgaaaaacctccttttgttctttga

SEQ ID NO: 4958 - RNA, 3162 nt, synthetic construct
  misc_feature 1..3162: note = Cas9 variant
  source 1..3162: mol_type = other RNA
atgaaaagaaactatattttgggactcgacattggcataacaagtgtaggatacggtattatagactacgaaacaagagacgttatagatgccggagtaagactattcaaagaagcaaacgtagaaaacaacgaaggaagaaggtctaagagaggcgcaagaagactaaaaaggagaaggcggcaccgtatccaacgagtgaaaaaattattgtttgattacaatctactcacagaccactccgaactatcgggcatcaatccatatgaagcgcgtgttaaaggactaagccagaaactatcagaagaagaattctcagcagccctactacatttagcaaaacgtagaggcgtacacaacgtgaacgaagtggaggaagataccggaaacgaattatccacaaaagaacaaatatctcgtaactccaaagcgttagaagaaaagtacgtagcagaactacaattagaacgattaaaaaaagacggagaagtacgcggatctataaaccgattcaaaacaagcgattatgtaaaggaagcaaaacaactgttaaaagtacaaaaagcttaccaccaattagaccaatcattcatagatacatacatcgacttactagaaacaagaagaacttattacgaaggaccaggagaaggatccccattcggctggaaagacataaaagaatggtacgaaatgctaatggggcactgtacctacttcccggaagaactaagatcagtaaaatacgcatacaacgccgatctgtacaatgcactaaatgatctaaacaatctagtaataacacgtgacgaaaatgaaaaactagaatactatgaaaaattccagataatcgaaaatgtatttaaacaaaaaaaaaaaccaacactaaaacaaatagctaaagaaatactagttaatgaggaagacataaaaggatacagagtcacctccacaggcaaaccagaattcacgaacctaaaagtataccacgacatcaaagacataacagcaagaaaagaaataatagaaaatgcagaactactcgaccaaattgcaaaaatcctaacaatataccaaagtagcgaagacatacaagaagaactgaccaatttaaacagtgagctaacacaggaagaaatcgaacaaatatcaaatcttaaaggatacactggcacccataatctgtctctcaaggcaatcaacctaatcctagatgaactttggcatacaaatgacaatcaaatagcgatattcaaccgattaaaactagtaccaaaaaaagtggacctaagccaacaaaaggaaatacccacaacactagttgacgactttatattatcacctgtagtaaaaagatctttcatacagtcgataaaagtaattaatgccatcataaagaaatacggattacccaacgatatcatcatcgaacttgcgagagaaaaaaactctaaagacgcacaaaaaatgatcaacgaaatgcaaaaacgaaacagacaaaccaacgaacgtatagaagaaatcatacgcacaacaggtaaagaaaacgctaaatacctcatagagaaaataaaacttcatgacatgcaagaaggcaaatgtctatactccttagaagccatccctctagaagatctacttaataaccccttcaactacgaagtagaccacataatccctagaagcgtaagttttgacaattcctttaataataaagtactggtaaaacaagaagaaaatagtaaaaaaggcaacagaactccatttcaatacctctccagcagtgacagtaaaatctcatatgaaacattcaaaaagcacattctaaacttagcaaaaggaaaaggaagaatatcaaaaacaaaaaaagaatacctcctagaagaaagagacatcaatcgattcagtgtccagaaagatttcataaatagaaacctagtagacacacgatacgcaacacgcggactaatgaacctcctcagaagctacttcagagtaaataatttagacgtcaaagtaaaatcaataaatggcggcttcactagcttcttaagaagaaaatggaaatttaaaaaagaacggaacaaaggatacaaacaccatgctgaggatgccctaataatagccaacgccgacttcatctttaaggaatggaaaaaattagacaaagctaaaaaagttatggaaaaccaaatgttcgaagagaaacaggcagaaagtatgccagaaatagagacagaacaagaatacaaagaaatctttataacaccacaccaaataaaacacattaaagacttcaaagactacaaatattcccacagggtagacaaaaaaccaaacagagaactcataaatgatacattatacagcaccagaaaagacgacaaaggaaatacactaatcgtaaacaacctaaatggattatacgataaagataacgataaactaaaaaaactcattaacaaatctccagaaaagctactaatgtaccatcatgacccacagacatatcaaaaactaaaattaataatggaacaatacggcgacgaaaagaatccactatacaaatattatgaagagacaggaaattacctaacgaaatatagcaaaaaagacaatggacccgtaataaaaaaaataaaatattacggaaacaaactaaatgcacacctagacataacggacgattatccaaatagcagaaacaaagtagtaaaactatcactaaaaccttacagatttgacgtttacctcgacaatggagtctacaaatttgtaacagtcaagaatctagacgtaataaaaaaagaaaactactatgaagtaaactcaaaatgctatgaagaagcaaaaaaattaaaaaaaataagcaaccaagccgagtttatagcaagtttctacaataatgacctaataaaaataaacggagaattatacagagtaataggagtcaacaatgatctacttaatcgaatagaagtcaatatgatagacataacttacagagagtacctagaaaatatgaacgacaaacgaccccctagaattataaaaactattgcaagcaaaacacaaagcatcaaaaagtattcaacagacatactcggcaatctctacgaggtaaagtcaaagaaacacccccaaatcataaaaaaaggctga

SEQ ID NO: 4959 - RNA, 3162 nt, synthetic construct
  misc_feature 1..3162: note = Cas9 variant
  source 1..3162: mol_type = other RNA
atgaaaagaaactacattcttggactcgatataggaatcacaagtgttggctacgggataatagactatgaaactcgcaatgtgatagacgccggagtacggttatttaaagaagcaaacgtagaaaacaatgaaggaagacgaagcaaaagaggaacaagaagactaaaaaggaggagacgccacagactccaaagagtaaaaaaattattatttgaccataatttcttgacagacaactcagagttaagtggaatatcaccatatgaggcacgagtcaaaggtctcaatcaaaaaatatcggaagaagaattctcagtagcactgttgcatcttgccaaacgaagaggggtacataacgttaacgaagtagaagaagacacaggcaatgaacttagtactaaagaacaaatatcccgaaactcgaaagccctagaagaaaaatatgtagcagaattacaactagaaagattaaaagtagatggagaagtacgcggagcggttaatcgattcaagacaagcgactacgtgaaagaagctcaacaaatattaaaagtacagaaagcatatcatcaattcgaccaaagcttcatagacacatatatcgacctactagaaacacgaagaacgtactacgaaggaccgggagagggatcacccttcggttggaaagacattaaagaatggtacgaaatgttaatgggacaatgcacatacttccccgaagagctgagaagcgttaaatacgcctataatgcagacctttacaacgcactaaacgacctgaataatctagttatagcaagagacgaaaacgaaaagcttgaatattatgaaaaattccagatcatagaaaacgtgttcaagcaaaaaaaaaaaccaactcttaaacaaatagccaaagaaatactcgtaaatgaggaagatataaagggttatagagtaacatccacaggaaaaccggaattcactaatttcaaagtataccatgacataaaatcaataaccagtagaaaagagatactcgagaacgccgaattgctaaaccaaatagcaaaaatacttaccatttaccaatcatccgaggacatacaaggagaactagcacgactatactcggaattaacccaagaagaaatcgaacaaataagcaaactagccggatacacaggcacccacagactatcattaaaagcaataaacctgatcatagacgaactatggcacacaagcgacaatcaaatggaaatatttaatagattaaagctagtcccaaaaaaagttgacttatcacaacaaaaagaaataccaaccactctagtcgatgacttcatattatctcctgttgtaaaaaggagtttcatacaaagcattaaagtcataaacgcaataataaaaaaatatggtttccccaatgacataatcatcgaactagcaagagaaaaaaatagtaaagacgcacaaaaattcatcaatgaaatgcaaaagaggaacagacaaacaaatgagagaatagaagagataataagaactacaggaaaagaaaatgccaaatacctcatagagaaaataaaattacacgacatgcaagagggcaaatgtttatactctctcgaagcaataccactagaagatctactaaacaatccctttaattatgaggtagatcacataattccgagatctgtatcctttgataattcatttaacaataaagttctagtaaaacaagaagaaaactcaaaaaaaggaaatagaacaccgttccaatacttctcatcctcagattcaaaaataagttacgaaatattcaaaaaacacatcctcaatttagcaaaaggaaaagggcgcatatcaaaaaaaaaaaaagagtacttactagaagaaagggacataaatagattctcagtacaaaaatacttcataaacagaaatcttgtagatacccgctacgcaacaagagaactcatgaacctacttaggagctatttccgagtaaatgatcttgatattaaagtaaaaagtataaatggaggcttcacaagcttcttacgtaagaaatggaaattcaaaaaagaacgcaacaaaggatacaaacaccatgctgaagacgcactaataatagctaacgcagactttatctttaaagaatggaaaaaactagacaaaacaaacaaagttatggaagatcaaatagtcgaagaacaacaagcagagtcaatgcccgagatagaaacagaacaagaatataaagaaattttcataactccacaccagattcaagatattaaggacttcaaagattataaatattcacacagagtagacaagaaaccaaacagagaacttgtaaacgataccctgtactcaacaagaaaagacgacaaggggaacacgcttatagttaataacttaaaaggtctctatgacaaagacaacgacaaactgaaaaaactgataaacaaatcacccgaaaaactacttatgtatcatcatgacccacaaacatatcaaaaactcaaagtaatcatggaacagtattctaatgaaaaaaacccgttatacaaataccatgaagaaaccggaaactatcttacaaaatattcaaaaaaagataacggaccagtaataaaaaaaattaaatattacggcaacaaattaaatgtgtacctagacataacacgggattacttaaaatcaaggaacaaaatagtaaaactaagcttaaaaccataccgcttcgatgtctacttagacaatggagtctacaaatttgttacagtaaaaaatttagacataattaagaaagaagattattatgaagtagactccgattcatacgaagaagcaaagatagtcaagaaagtttctgaacaagcacaattcgtagcaagcttctataacaacgaccttataaaagttgatggcgaactattcagagtaattggcgtaaacaatgacttactaaacagaatagaagtaaatatggtagacattacatataaggaatatctagagaacatcaatgacaaaaaatcaagccgaatcataaaaacaatcagttctaaaacacaaagtataaaaaaatacagcactgacattttaggaaatttatacgaagcaaaatccaaacaaagaccacaaatgacaatgaaaggttga

SEQ ID NO: 4960 - RNA, 3162 nt, synthetic construct
  misc_feature 1..3162: note = Cas9 variant
  source 1..3162: mol_type = other RNA
atgaaaagaaactatatactcggtctagatataggaataacatcagttggttacggaatcattgactacgaaacaagagacgtaattgacgccggtgtaaggctatttaaagaagcaaatgtagaaaataatgaaggaagaagaagtaaaagaggtgccggccgtcttaaaagaagacgtcgacaccgtctacagcgcgtaaaaaaacttctattcgattacaacctattaactgaccattcagaactctcaggcatcaacccatacgaagcaagagtcaaaggcctatcacaaaaactatccgaagaagaatttagcgcagccctattacacctcgcaaaaagaagaggtgtacataatgtaaacgaagtagaggaagacacgggtaatgaactaagtacaaaagaacaaatctcccgaaatagcaaagcacttgaagaaaagtatgtcgcagaattacaattagaaaggctaaaaaccgatggtgaagtacgtggaagcataaatagattcaaaacatccgactatgtcaaagaagcaaaacaattactaaaagtacaaaaagaatatcaccaattagaccaatcattcatagacacatacatagatctattagaaactagacgaacatactacgaaggtccaggcgaaggatcaccatttgggtggaaggacataaaagaatggtacgaaatgctcatgggacactgcacctatttcccggaagaactcagatccgtaaaatatgcctacaacgcagacctttataatgcactaaacgaccttaacaacttagtaatagcaagagatgaaaacgagaaattagaatattacgaaaaattccaaataatagaaaacgtctttaaacaaaaaaaaaaacctacgttaaaacaaatagaaaaagagatattagtaaacgaagaagatatcaaaggatacagagtaacgtcaacaggaaaacccgaattcagtaacctcaaagtataccacgatataaaagacataacagcaagaaaagaaataattgagaacgcagaactgctagaccaaatagccgaaatactaacgatatatcaatcatctgaggatatccaagaagaactcgtcaaattaaattcagaactaacacaagaagaaatagaacagataagtaacttaaaaggttatacgggaactcataacctatcattgaaagctataaatctaatattagatgaattatggcatacaaacgacaaccaaatggcaatattcaacagactaaaacttgtaccaaaaaaagtagacctaagccaacaaaaagaaatcccaactactctcgtagatgacttcatactatccccagtagtcaaaagaagcttcatacaaagcataaaagtaataaacgccattataaagaaatacggccttccaaatgacatcatcatcgaactagcaagagaaaaaaattctaaagatgcccaaaaaatgatcaatgaaatgcaaaaacgtaatcgacagaccaatgagagaatagaagaaataataaggaccactggaaaagaaaacgcaaaatacctgatagaaaaaatcaaactacacgacatgcaagaaggcaaatgcttatattctctagaagccataccgctagaggacttattaaacaatccatttaactacgaagttgatcatatcataccgaggtcagttagtttcgacaactcgttcaacaataaagtcctagtcaaacaagaagagaacagtaaaaaaggaaaccgaacaccttttcagtatctcagctcctcagattcaaaaatatcatatgaaacctttaaaaaacacatactaaatttagcaaaaggaaaaggacgaatatcaaaaaccaaaaaagaatatcttcttgaagaaagagatatcaacagatttagtgtacagaaagatttcattaatcgaaacctagtggacacgcgatatgcgaccagagaactcatgaacctattaagaagttactttagagtaaacaacttagatgtaaaagtaaaatcaataaacggcggatttacatcattccttcgaagaaaatggaaattcaaaaaagagcgaaataaaggatacaaacaccacgcagaagacgcactaataatagcaaatgcagacttcatatttaaagaatggaaaaaattagacaaagcaaagaaagttatggaaaatcagaccgtagaagaaaaacaagcagaaagtatgagcgaaatagaaacagaacaagaatataaagagatcttcataacacctcaccaaatccaacacattaaagatttcaaagattacaaatactcacatagagtagacaaaaaaccaaatagagaactcataaatgacacactctactcaacaaggaaagacgacaaaggaaatacacttatcgtaaacaacttgaatggtttgtatcacaaagacaacgacaaactaaaaaaactaatgaataaatcaccagagaaactactaatgtaccatcacgacccacagacataccaaaaactaaaattaataatggaacaatacggagatgaaaaaaatccactctacaaatattacgaggaaacaggaaactatttaacaaaatattcaaaaaaagacaacggaccagtaatcaaaaagatcaaatattacggaaacaaactaaacgcgcacctagacataacagacgactaccctaactcacgtaataaagtcgtaaaactttcactaaaaccatatagattcgatgtatatctcgataacggagtctacaagtttgttaccgttaaaaacctaaacgtcatcaaaaaagaaaattattatgaagtgaacagtaaatgttacgaaaaagccaaaaaactgaaaaaaatatcggaccaagccgaatttatagcatccttttataacaacgatttaataaagatagatggcgaactatatcgagtcataggagtaaatacagacttaatcaaccgcatcgaagtcaacatggtagacatcacatacagagaatacctcgaaaatatgaacgacaaaagatcgcccagaatctttaaaacaatagcatcaaaaacacaatccattaaaaaatattctacagacattctaggaactttatatgaagtaaactcaaaaaaacaccctcaaatgataatgaaaggatga

SEQ ID NO: 4961 - RNA, 3162 nt, synthetic construct
  misc_feature 1..3162: note = Cas9 variant
  source 1..3162: mol_type = other RNA
atgagtggaatggttttcggtatagatttaggaatagcaagttgtggctgggctgtgctaagacaaccacaaagagatggcgaccccggcgagatagtagacttaggaagttggatgtttgatgtaccagagactgataaagaaagaacacctacaaaccaagttcgcagaggcaaccgtttgttaagaagggtaataagaagaagggcgcaaaggatggtggagattagaagacttttccatgaccatggactattagctggacacgcacctgaagcactgaaaagagcaggtttggatccttgggaccttagagccaggtcgctagacaaagtcttggagccagctgccctagcggtagctttaggacatatcgcgaaaaggaggggattcaaatccgcagcaagaaggaaagaagctaatacagccggagatgatcagaaaatgttaaaggctttggaggccacacatgaaagacttggaagatatagaacaattggagagatgttcgccagagacccagattttgagtcaagaaaaagaaatcgagatggaatgtttgacagaacacaaggtcgagatgatttattacatgaagtaggcgaaatctttaaagcacaaaggaggctcggcagtgcattagcaactgctgaattggaacaggctttcacagcaatagcctttagacaattaccaatacaagattcagaacggctagtagggttgtgtcaatttgagccaaaagaaaagcgagcagcacgattcgcaccaagttttgaaagatttaggttgttacaacgattgacaaatttgagagtagtaacagttgaaggagaaagacccttaactgctgatgaaatagcagcggcagcagcagatctaggtcgaactgcaaaattatccgtaaaagaagtacgtaaacgaattggattagcagcagatcacagattcgcggcttttaaagcagatgaagaagatagagacattatagcaagaacaggagaggcactacacgggacatatcgattgagaaaggcattaggggaaggtttatgggcggaaatgttaccaggacaacttgatgcaattgcacatgcacttagcttctttgagacacaagatgtgattttaaaagaattagacaaactagatttgcccgccggcgtcagagatgcaattgccacaggcttagatgcgggagcatttgcaagatttaaagggacaggccacatatcagcacgtgcggccagagctttactgccgcatctggaagcaggactgagatatgatcaagcgtgcacaaaagcaggttatgaccatgccgcttcaagatgggcaaaacgtgaacaggtagccgacaaagcagcatttaacagattagtaacggacatgggtgctgaaatagcgaatcctatagcaagaaagagcttaacggaagcattgaaacagctgtgggcgatgagaaatagatggggacttccggatgctatacatatagaattggcaagggatgttggtaactcgttggagaaaagaagagaaatcgaaagagcaattgagaaaaacactgcagcgagagaaagagaaagaggagaagcgagagacctacttggcattgatgatgtcagtggcgatactctcctaagatatagactatggaaggaacaggcaggcagatgtccatatacggatgcaccaatcccaccaggagcaataatagcaaccgataacagttttcaagtggatcacatattaccctggagtagatttggtgatgatagttttgcaaataaagtactatgtgcaacagcagccaatcaaagaaagaaaggacaaacaccttgtgaatggataactgcagctcaaggggaagaagggtgggccacatttgtagctagaatagaaggcaatgctgcattcaggggacctaagaaaaggaactatgtattaaagaacgcgaaagaagccgaagaaagatttagggcgagaaatttaaatgatacaagatacgcagcaagactattggctgaggcagtaaaattattctatccagaaggtgaaaggcaggacaaaggtggagtaaggcgagttttcaccagaccaggaggactaacagcggcccttagacatgcatggggcgttgaggctttaaagaaaagagacggtaagcgtgtagatgacgctcgacaccacgcgttagacgctttagtagtcgcagctataggagaaggtgaagttcaaagactaacaagatcatatcaagaatgggaacaacaaggattagctaggccattaagacgagtagatccaccatggggagatttccatagcttcagacgcgaagttaaagatgcctacgatggaatttttgttgcaagaccagaaagaagacgagcgagaggtgaaggccacgcagccacgataaggcaagtacgagaacgagatggggcagccgtcgtttttgaacggaaagcaatcgcagacctgagtgagaaaagactcgcagatataaaggacccagaaagaaatcaagcgattgttgaagctatacgacaatggatagtagacggaagaccagcagatagattaccgagaagtccagccggtgatgaaataaggaaagttagattacgaactaaaggaaaaccggcagtacaagtacgaggaggggcagcagatcgaggagaaatagtaagagttgacgtatttaccaaaccaaacaagaaagggaaaaatgaattttacctggtaccaatatacccacatcaagtcatgaataaagcagagtggccaacgccccctatgagggcagtcgtcgcgtataaagatgaatctgaatggaccctactagatgaaaacttcggatttctattctcattatttccaagatcatatgtcgaagtgactaaaccgggaggagaagtattgagcgggtactttcaaggtatggatagaagtacaggagcgatatcactgttcaatcaccgagattcaagatcacttacggatgatagcggaaatagtacaagaggaataggtgccaaaactctattaacaatgaagaaatatagcgtggatagatttggaaaaagagctgaagttaaatcagaagtccggacatggcacggtgtagcgtgtacatatcctacaccaccagggtga

SEQ ID NO: 4962 - RNA, 3165 nt, synthetic construct
  misc_feature 1..3165: note = Cas9 variant
  source 1..3165: mol_type = other RNA
atgaaactaacaccactcaattatatactaggcttggatctaggaatagcatcagtagggtgggcggtcgtagaaatagacgaacaagaaaatccgcttggacttattgatgtaggtgttaggacttttgatagagcagaagtcgcaaaaacaggtgaatccttagcattagctcgaaggttggcgcgaagttcaagaagacttgtgaaaaggagagctgacagaataaagaaagtaaagagactattaaaatcagaaaatatattattaagcgcagatgaacaattaccaaatgatgtatggcaattaagggtaaaagggctagatcaaaaacttgaaagacaagaatgggcagccgtactactacatttactaaaacatcgagggtatttaagccaaaggaaaaacgaaagtaaaagtgaaaacaaagagctcggcgcactaagatccggagtggcagctaatcaccaaattttgcaatcagccgaatatagaacaccagcagagatagcagtaaagaaattccacgtagaagaaggacatataagaaaccaaagaggagcatatactcacacctttagtaggctcgatctactagcagaaatagaattattattcacaagacaaacagaactcggcaatccacatacaagcgcgaaattgttagaaaacctcaccgccttgctaatgtggcagaaacctgcattagcaggagaggcaatcttaaaaatgttaggaaaatgtacgtttgaacctacggaatacaaagcagctaaaaactcctactcagcagagaggttcgtctggttaacaaaactaaataacttaagaatactcgaacaaggagcagaaagagcactaacagataatgaaaggtttgctctactagaccaaccatacgaaaaagcaaaattcacatatgcacaagcaagaactatgctcgcgctaccagatgaggcaatatttaaaggggtaaggtaccaaggagaagataagaaagctgtcgaaacaaaaacaatacttatggaaatgaaagcatatcatcaaatacgaaaagcactggagaacgccgatctaaaagctgaatggaacgaactgaagaataactcagaactacttgacgacataggaactgcatttagtttacataaaacagatgaggacatatgccgataccttgacggtaaattatcagaaagcatattgaacgcactactagaaaatctaaattttgacaaatttattcagttaagcctcaaggctttacaacaaattctacccctaatgctacaaggacaaagatatgatgaagctgtatccgcaatctatggagaccattacggaaagaaaagcgctgaaattaaccgcttattacctacaatccctgcggatgaaataagaaacccagtagtactcagaactctcacgcaggcaagaaaagtaataaatgcagtggtaagattatacggatcccctgcacgaatacacattgaaaccggaagagaagtaggaaaatcatatcaagatagaaagaaactggaaaaacaacaagaagataatagaaaacatagagaaagtgctgtacaaaaatttaaagaatattttccaaattttgttggtgaacctaaaggcaaagatattctaaaaatgagattatacgaattgcaacaagccaaatgtctttattccggaaaatcgctagaattacaccgcttattggaaaaaggatatgtcgaggtcgatcacgctctaccgttttcgagaacatgggacgactcatttaataataaagtattagtccttgcaaatgaaaaccaaaataaaggaaacttgacaccatatgaatggctagacggtaaaaataattcggaaccttggcaaaatttcgtcgcaagagtgcaaacaagcgggttctcacatacaaagaaacaaagaatattgtcacataaactagatgagaaaggttttattgagagaaacttaaatgacactagatatgtagtaagattcttatgcaattttatagcagataatatgctgttaacaggtaaaggaaaacgaaaagtatttgcatctaacggacaaattacagctttattaagaggtcgatggggactacaaaaagtaagagatgataacgatagacatcatgcattggatgcagtggtagtagcctgttcaaccgtagcaatgcaacagaaaataaccaggtttgttagatacgaagaaggaaacgtattcagcggagaacgaattgacagggagacaggggaaattataccacttcattttcccagtccatgggcgttcttcagggagaatgtagaaatccgaatattttcagaaaacccaaaattagaactagaaaatagattaccagactatccacaatataaccatgagttcgtacaaccactatttgtaagtcgtatgccaacacgaaaaatgacgggacaaggacatatggaaactgttaaatcagcaaaaagattagatgaagggttatccgtattaaaagtaccattaacacaattaaaactaaatgacctagaaagaatggtcaatagagaacgagaaatggcattatatgagtcattaaaagtacgtctagaacaattcgataatgatccagccaaagcattcgctgaacccttttataagaaaggaggagccctagtaaaagcagtaagagtcgaacaaacacagaaaagcggtgtactggttagagacggcaatggagtagcagacaatgcgagtatggtacgtgtcgacgttttcacaaaagcaggtaaatattttcttgtccctatttatacatggcaagtcgcaaaaggtatcctacctaataaagcagtaacggcaaacgtagatgaaatagattggctagagatggacgagagctatcaattcatattcactatgtatccgaatgatctggtcaaagtcaaattaaagaaagaagagttctttggatattatggaggacttgatagagcaactggagctatagtgattaaagaacatgatctagaaaaatcaaaaggtagacaaggaatctatagaattggtgtaaaattagcactaagtttcgaaaaatatcaagtagatgaattaggcaaaaacataagaccctgtcgtccaacaaaaagacaacacgttagatga

SEQ ID NO: 4963 - RNA, 3165 nt, synthetic construct
  misc_feature 1..3165: note = Cas9 variant
  source 1..3165: mol_type = other RNA
atgcgaatactcggagtagacctaggagtagcctcagttggttgggctttagtgaacgataaaaataataaaataatagattcaggagttcgcatattcacacagtcaaccaacagagagggaaaaacactagccgcagtacgacgatcatttaggggaggaagaagagtcctaagtagaagaaaacaaagattaaaccaattaaaaaaactatttattgcccacaaattgctatcaaaatcagaattcaaacacctcttcaacagcaaaaacagactagacatatggcaactacgtgcaaaaggacttgaacaacaactaaacaacaaagaatgggcgagagtactgtatcacattgcaaaacgccgagcttaccaatcaaatcgtaaatccgaagaatctggaaacaccgacaaaaaaaaagtactaagtggcatctcaaaaaacgagaaaaaaatgaacgaattaggttacaaaacaattggcgaaatgttatatactgaaaatagataccctgataatcggataagaagaaataaaaaagaccagtataaacactcaatcagcagagatttactaagaaaagaaatagacgttctatttgaaagtcaaagagattttggtaatcagtttgctactgatggattaaaagaacactacaaagatatcgcattcacacaaagaccaataaaattcaaagcagatttagtcggtaaatgtaccttcgaaacacaagagtaccgaggtgctaaaaactgcttcagtgtcgaaaaatcaactctcctatcaaaaatcaataacacagacctaatagacaaatcaaccggcgaaattaaaagattatttgaaataagcgaattcgataaactattagatatattttattcaatcaaagaagtaaaatacacaacactccgaaaacaactcaaaattacggatgcctttaaattcaagcaattagactaccatcaaaactttgaatacaaaacaaacataaaagccaaaatagaagacttctataaattagaagattggctaactccagaacaaaaagtgttattagaaaaacaagttctcgacgacaaaaaagaaaaatttaaatgttacaaatatagctctattagatcaatactctcacttagtgaatcccaaaaattcaatggagtgaaatatgatacaaaagtggaaaatacagtattcggaaaactaaatggataccattcaattaaaaaagaactaaacaaagaagtattcgacctattattcatcgataaagacaaattcaacaaaattgcagaaatactctcgtaccagaaagatgacaaatcagcaacccaagatctaaaaaaacaagtattcaatgattttaacatggataagacaattgtaaacgaagcaatcaattcattactaaatatatctttctcaggattcaactcattatcattaaaagcaataaacaaattgttaccatatttatgccaaggactaaaataccatgatgcagtagcacactcggaatataaacatcatagtcaattcaaggcagcaaatcctcaacaatacctacgacctctaaacaaagaagaaaactaccagattaccagtccaactgtaaaacgagtcttctctcaattccgaaaagttctaaatgcagtaatacgcaaacatggcagcttcgatgcaatgcacattgaaatggccagagaactcaaaaattcaaaaaagataaaattcgaaatacaaacaggacaaaaggaatacgcacaagaaaaagaagcaataagggtcaaattcctagaaatattcaaatacgaaggttccggacgagatctcctaaaacttagattatacgaacaacagcatggcaaatgtatctacagtaaaaaagaaatagaaataaataaattattagaagacggatatgtagaaattgaccacatcctaccttggtcaagaacattcgacaattcactaaacaacaaagcgctgtgcttaagcgctgaaaaccaaaacaaagccaatcaaacaccattcgaatatttaacgaactccgataaaaatagcaaagatagtaaagaatggcaggagtacaagaactatgtaagctcattcgcaggaattaaacaggcaaaaaaacataaactactaaatacaacgctaccaccccgaaggggtaatgactttagcgatgatataaaaaatccagaatcaggattcttagcaagaaatctcaacgacacagcatatgcttcacgatttataaaaaacttcgtacaaaaccatctacagttctcccaaaatgacacaataaaacaaaaagtcaaagtacgtagcggtgcactaacaaaccagctgagatacaattggggaatagaagaaaaaaaccgcgataacaacctacatcacgcggaagacgcaattatattagcattcgcaactcaaggagaagtgcaaaggatgtcaacaataagcgcaaaacgagaagacttcaagtatcaaacggccaaggaacgaaaaataaaattcacaccaccattttccgatttcaaatccgtattagacgaatcagtaggcgacattttcgttagttttgcacccagacgaaaaatatcaggagcagcacacaaagcgacaataaaacctaaagatacaggaggtaaatacaaattcccggtaaataacggcatggcagaaaatggagtaatacagagagtcgatgtatttaaaaatgcaaaaaataaatatcaattcatagttttctaccctgcagatttttacaaagacgacttcccagaattagacctcaagggcaacgaaatagataagaacgtccaatttttattttcactattcaaagacgacctcatagaatttaagaccaaaaaaacaaaaacaaaagacagtaaacatcttttagcatacttcaaatacatcagatcagatggaaaaatagccttccaacagaattacaaagctgaaatagaaagaaaagaatcagacaataaaaaaggatacaaagacatcctactagcaacagggagtggactagcctcattaaaaaaatatcaagtaagtgtactaggcgacatagcagaagtaaagaacgaaaaaagattaccactaataaaacaaatgtataaaagcaaaccgaagaaaaaatga

SEQ ID NO: 4964 - RNA, 3165 nt, synthetic construct
  misc_feature 1..3165: note = Cas9 variant
  source 1..3165: mol_type = other RNA
atgaaccaaaaatttatcttaggattagacataggcataacatcagttggatacggattaatagactatgaaaccaaaaacatcatagacgcaggagtaagacttttccctgaagcaaatgtagaaaacaatgaaggacggcgaagtaaaagaggatcaagaagactcaaacgaagaagaatacatcgactagaacgtgtcaaaaaactattggaagactataatttattggatcaatcacaaataccacagagtaccaatccatatgcaatacgagtcaagggcctctcagaagcattatcaaaagacgaactcgtaatagccttacttcacatagcaaaacgtagaggaatccataagatagacgtaattgactcaaacgacgacgtaggcaacgagctatctacaaaagaacaactaaataaaaactctaaactactcaaagacaagttcgtctgccaaatccaactagaacgaatgaacgaagggcaagtacgcggcgaaaagaacagattcaaaaccgcagatataataaaagagataatacaactattaaacgtacaaaaaaacttccaccagctagacgaaaatttcattaataaatatattgaactagtagaaatgcgcagagaatattttgagggtccagggaaaggtagcccatacggatgggaaggggatcccaaagcctggtacgagaccttgatgggacattgcacttacttccccgatgaacttcgaagtgtcaaatacgcctattctgccgatctcttcaacgcattaaacgaccttaataacttagttattcaaagagacggactatcaaaactagaatatcatgaaaaatatcatatcatagaaaatgtctttaaacaaaaaaaaaaacccacactaaaacaaatagcaaacgaaataaacgtaaatccagaagacatcaaaggatacagaataactaaatcaggaaaaccccaattcacagaatttaaattataccacgatctcaaatctgtactattcgaccaatcaatcctagaaaacgaagacgtactcgatcaaatagcagaaatactgacaatataccaagacaaagactcaattaaatccaaactaacagaattagatatactactcaatgaagaagataaagaaaacatagcgcaactaactggatataccggcactcacagactgtcactcaaatgcatacgtcttgtattggaagaacaatggtatagctcccgcaatcaaatggaaatcttcacacatctaaacataaaaccaaaaaaaataaacctaacagcagcgaacaaaatcccaaaggcgatgatcgacgaatttatattaagtccagtggtcaaacgtacattcggtcaagcgatcaacctaataaacaaaataatcgaaaagtacggagttccagaagacataataatagaactcgcgagagagaacaactcaaaagataaacaaaaatttataaacgaaatgcaaaagaagaatgaaaacacacggaaaagaataaacgaaataattggcaagtatggaaaccagaacgccaaaagactagtagaaaaaataagattacatgacgaacaagaaggaaaatgtttatattcattagaatcaatccccctagaagacttactcaataatccaaatcattatgaagttgatcacatcataccaagatcagtatcattcgataactcctaccataacaaagtattagtaaaacaatcagaaaattcgaaaaaatctaatttaacaccgtaccaatacttcaactcaggcaaatcaaagttatcatacaaccaattcaaacaacacatattaaacctaagcaaaagtcaggacagaatatcaaaaaagaaaaaagaatatctattggaagaaagagatatcaacaaattcgaggtacagaaagaatttataaatagaaatctcgttgacaccagatacgcaacacgggaactaacaaattatcttaaagcctacttcagcgcaaacaatatgaatgtaaaagtaaaaactataaatggatcattcacagactatctaagaaaagtatggaaatttaaaaaagaaagaaaccatggatacaagcaccatgctgaagatgccctaatcatagctaacgccgactttttatttaaagaaaacaaaaaacttaaagccgtcaattccgtattagaaaaacctgaaatagaatctaaacaactggatatccaagtcgactcagaagacaactactcagaaatgttcattatccctaaacaagtacaagacataaaagacttccgtaattttaaatactcacaccgagtcgacaaaaaacccaatcgccaactaataaatgatacactgtattcaaccagaaaaaaagacaactcaacttacatagtacaaacaattaaagacatctacgcgaaagacaacacaacactaaaaaaacaattcgataaatcacccgaaaaatttctaatgtaccagcatgacccccgcacattcgaaaaattagaagtcatcatgaaacaatacgcaaacgaaaaaaacccactggctaaataccacgaagagacaggcgaatatctaacaaaatattccaaaaaaaacaatggtccaatagtcaagtccctaaaatatattggaaacaaactaggatctcatctcgacgtaacgcaccagtttaaatcaagcacaaaaaaacttgtaaaactaagcataaaaccatacagatttgacgtatatcttactgacaaaggatacaaatttatcacgatatcatacctagatgtactcaaaaaagacaactactactacataccagaacaaaaatacgataaactaaagctaggcaaagcaattgacaaaaacgccaaattcatagcatcattttataaaaacgacctaataaaactcgacggtgaaatttataaaataattggcgtcaatagtgacacaagaaacatgatagaactggatctgccagacatacgttacaaagaatactgcgaattaaacaacattaaaggagaacctagaatcaaaaaaacaataggcaaaaaagtcaactcaattgaaaagctaacaaccgatgttctaggcaacgtatttacaaatacacaatacacaaaaccgcaactcctttttaaaagaggtaactga

SEQ ID NO: 4965 - RNA, 3165 nt, synthetic construct
  misc_feature 1..3165: note = Cas9 variant
  source 1..3165: mol_type = other RNA
atgaaattgacacctttgaattatatacttggattagatttaggaattgcttcagttggatgggctgttgtagaaatagatgaacaagaaaatcctttaggccttatcgatgtaggagtacgcacgtttgacagggctgaagttccaaaaactggagaatcactagcacttgctcgaagactagcacggtcagctaggagattagtcaaaaggagagcagacagaataaagaaagcaaaaagattactaaaagcggaaaatatactactaagtgctgatgaacaccttccaaatgatgtatggcaattaagagttaaaggtctcgaccaaaaattggaaagacaagaatgggcggcagtattactgcatttacttaaacaccggggatacctgtcacagcgtaaaaacgaaagcaaatcggaaaacaaagaacttggcgcactgcttagtggcgtagaaactaatcatcagatcttacaatcagcagagtatagaacaccagcagaaatagctgtaaagaaatttcatgtagaggacggacacattagaaaccagcgaggagcgtatacacatacattttcacgacttgatttacttgcagaaatggaattattatttcaaagacaaacagacttaggaaatcctcatacttctgcaaaattattagaaaacctaacagctttattaatgtggcaaaaaccagcattagcaggcgaagcaatattaaaaatgctcggaaaatgtacatttgaaccaactgaatataaagcagccaaaaatagctattcagcagaaagatttgtatggttaaccaaattaaacaatcttaggatactagaacaaggagcagaaagagcacttacagataatgaacgattcgccctcctggatcaaccatacgaaaaagccaaatttacatatgcacaagcacggacaatgttagctttaccagatgaagccattttcaaaggagttcgttatcaaggagaggacaagaaagcagttgaaaccaaaacgatactaatggaaatgaaagcctatcaccaaatccggaaagcattagaaaatgctgatctaaaagcagaatggaacgagctcaaaaacaactcagaactcttagacgacataggtaccgcgttcagcctacacaaaacagatgaggacatatgtagatacttagatggaaaattgagtgagtcaatattgaacgcattattagaaaacttaaattttgataaattcattcaactttcactgaaagcactacaacaaatacttccattaatgcttcaagggcagagatacgatgaagcagtttcagctatctatggagaccattatggcaaaaagagtgcagaaataaaccgattactaccgaccattccagctgacgaaatcagaaaccccgttgtcctccgaacattaacccaagcaagaaaggttataaacgctgtagtcagactttatggaagcccggcacgaatccatatagaaacgggcagagaagtaggaaaaagttaccaagaccgaaagaaattagaaaaacaacaggaagacaacagaaaacaaagagaatcagcagtaaagaaatttaaagaatatttccctaattttgttggagaaccaaaaggaaaagatattctaaaaatgcgcttatatgaactacaacaagcaaaatgtttatacagtggtaaatcactagaacttcatcgtttattagaaaaaggttacgtagaagtagatcacgctctcccattcagtagaacttgggatgacagtttcaataataaagtgctagtattagcaaatgaaaaccaaaataaaggtaacttaacgccatatgaatggttagacggtaaaaacaattcagaacactggcaaaattttgtagctagagtacaaacaagtggattctcacacactaagaaacaaagaatcttgtcccacaaactcgacgagaaaggatttatcgaaagaaacttaaacgatacaagatacgtcgcgagatttctatgtaacttcatagctgacaatatgctattaactggaaaaggtaaaagaaaagttttcgcttcaaatggacaaatcactgctttactaagaggtagatggggactacaaaaagttcgggatgacaatgatcgtcatcacgccttagatgcagtcgtcgttgcatgttctacagtagtgatgcaacagaaaattacacgatttgttagatacgaagaaggcaatgtgttttcaggagaaagaatagacagagaaaccggagaaatcatcccattgcactttccaagtccctgggcattctttcgcgaaaatgtcgaaataagaatatttagtgaaaatccaaaactagagttagaaaatcgcttaccggactatcctcagtataatcatgagtttgtgcaaccattatttgtaagtagaatgccaacaaggaagatgacaggacaaggtcatatggaaacagtaaagagtgctaagagactagacgaaggattaagcgtattaaaagtcccattaacccagttaaaattatcagatttagaacgtatggttaacagagaacgtgaagtaacattatacgaaagcctaaaagcaagattagaacaatttggaaatgaccctgcaaaagcctttgcagaaccatttcataagaaaggaggggcagtcgtcaaagctgtaagagtagaacaaacacagaaaagcggagttctggtcagagatggaaacggtgtcgccgataacgcaagtatggtccgagtcgatgttttcacaaaaggaggaaaatacttcctagtacctatatacacatggcaagtagccaaaggaatattacccaacaaggcagtaacagccaatgtagacgaaatagactggttagaaatggatgaatcataccaatttatattcacaatgtatccaaatgatctagtaaaagttaaactaaagaaagaagaatttttcggttattatggtggactagaccgagctacaggagcaattgtcataaaagaacacgacttagagaaaagtaaagggaaacaaggcatatatcgaataggagtgaaattagcactaagttttgaaaaataccaagtagatgaactagggaaaaatataagaccatgtagaccaaccaaacgacaacacgtcagatga

SEQ ID NO: 4966 - RNA, 3165 nt, synthetic construct
  misc_feature 1..3165: note = Cas9 variant
  source 1..3165: mol_type = other RNA
atgaaagaaaaatatattttagggctagacctaggtatcacttcggtaggatacgggatcataaacttcgaaactaaaaaaatcatcgatgcaggagtacgcttattcccagaagcaaacgtcgataacaacgaaggcagaagatccaaacgaggcagtagaaggctaaaaaggagacgaatacacagacttgaacgtgttaaactattattgaccgagtacgacctaattaacaaagaacaaataccaacctctaataacccctaccaaatccgagtaaaaggactatcagaaatattatctaaagatgagctagccatagccctacttcatttagcaaaaagacgtggaatacacaatataaatgtaagctccgaagatgaagacgctagcaacgaactatcaacgaaagaacaaataaatagaaataataaattactaaaagataaatatgtatgtgaagtacaactacaaagactcaaagaaggccaaattcggggagaaaaaaaccgcttcaaaacaacagatatactaaaagaaatagaccaactcttaaaagtccaaaaggattaccataatttggatatcgacttcatcaatcaatacaaagaaatcgtggaaacacgcagagaatactttgagggcccaggacaaggcagcccttttggatggaatggtgatctcaaaaaatggtacgagatgctgatgggacactgcacctacttcccacaagaactaaggagcgttaaatacgcctactccgcagacctcttcaacgcgctaaatgacttaaacaatctcataatacaaagagataattctgaaaagctagaatatcacgaaaaatatcatatcatagaaaacgtattcaaacaaaaaaaaaaaccaacattaaaacaaatcgcaaaagaaattggagttaacccagaagatataaaagggtaccgcataactaaatcaggaaccccacaattcactgagttcaaattatatcatgatcttaaaagtatcgtcttcgacaaatcaattttagaaaatgaagccatcctcgaccaaatagctgaaatcttaacaatataccaagatgagcaatcaataaaagaggaactaaacaaacttcctgaaatattaaatgaacaagataaagccgaaattgcaaaattaattgggtacaacggtacacaccgtctatcacttaaatgcatccatctaataaacgaagaattatggcaaacatccagaaaccaaatggaaatcttcaattacttgaacataaaaccaaacaaagttgatttatcggaacagaacaaaatacccaaagatatggtcaatgacttcatcctttcaccagtagtaaaaagaacattcatacaaagtataaacgtaataaacaaagtaatagaaaaatacggcataccagaggacataataatcgaactcgcgcgagaaaacaacagtgacgatagaaaaaaattcataaataatctacaaaaaaaaaacgaagcaactagaaaaagaataaacgaaataataggacaaacaggcaatcaaaacgcaaagagaatagtggagaaaataagattacacgatcaacaagaaggaaaatgcctatactcactagaaagcatagcactcatggatctactaaacaatccacaaaactacgaagtcgaccatataattccaagatccgtcgcattcgataattcaatacacaacaaagtactagtaaagcaaatagaaaattcaaaaaaaggcaacagaacaccataccaatacctcaatagttcagatgcaaaattaagctataatcagttcaaacaacatatcctcaacttatccaaatctaaagatcgcatttcaaaaaaaaaaaaagattacttactagaagaaagagacataaacaaattcgaagtacaaaaggaattcataaatagaaatctagtagacacccgatatgctacgcgagaactaacctcctatctcaaagcttacttctcagccaacaatatggatgtgaaagtaaagaccataaatggctctttcacgaaccatttaagaaaagtatggagattcgataaatatcgaaaccacggatataaacatcacgccgaagacgcactcatcatagcaaacgccgactttttatttaaagaaaataaaaaactacaaaacacaaacaagatactggaaaaacccacaatagaaaataatacaaaaaaagtaacagtcgaaaaagaagaagattacaacaatgtgtttgagacacccaaacttgtagaagatatcaaacaatacagggactacaaattctcacaccgcgtagataaaaaaccaaacagacaactcataaatgacaccttatatagcactcgaatgaaggacgaacatgactacatagtacaaactataacagacatatacggaaaagataacacgaacctcaaaaagcaattcaacaaaaacccagaaaaattcctaatgtatcagaatgatccaaaaacttttgaaaaattgtcgataataatgaaacaatactcagatgaaaagaacccccttgcaaaatactatgaagaaactggagaatatttaaccaagtacagcaaaaaaaacaacggaccaatagtcaaaaaaattaaactgctaggcaacaaagtcggtaaccacctagacgtaacaaacaaatatgaaaactcaactaaaaaattagtaaaactttccataaaaaactaccgcttcgacgtatacttaacagaaaagggctacaaatttgtaacaatagcctacttaaacgtatttaaaaaagacaactactactacataccaaaggacaaataccaagaactaaaagaaaaaaaaaaaatcaaagatacagaccaatttatagcatcattctataaaaacgatctaataaaactgaatggtgacctatacaagatcattggagtaaactctgacgatagaaacataatagaactagattattacgatataaaatacaaagattattgcgaaataaacaacataaaaggcgaaccgagaattaaaaaaaccataggaaaaaaaacagaatccatagagaaatttacaaccgacgtcctaggaaacttgtacctccattcaacagaaaaagcaccccaactaatcttcaaacgaggcctctga

SEQ ID NO: 4967 - RNA, 3165 nt, synthetic construct
  misc_feature 1..3165: note = Cas9 variant
  source 1..3165: mol_type = other RNA
atggaaaataaaaatttaaattatatcttaggattagaccttggaattgcaagtgttggatgggccgtagtagaaatcgatgaaaaagaaaacccattaagactaattgatgtaggagttagaacattcgaaagagcagaagtaccaaaaacaggagaatcattagcattatcacgaaggctagcaagatctgcaagaagactaacccagcgaagagtggcgcgcttgaagaaagcaaaaagactcttaaaatcagaaaacatacttttgtcgacagacgagagactgccacatcaagtatggcagttacgagtagaagggttagaccataaactcgagcgacaagaatgggccgcagtcttactgcatctaataaaacacagaggctatctaagccaaagaaagaacgaatcaaaatcagaaaataaagaattaggagcattattatcaggagttgataacaatcacaaattactacaacaagctacatacaggtcacccgcagaattagcggtaaagaaatttgaagtcgaggaaggacatatcaggaatcagcaaggagcctacacgcatacattctcacgtctagatttattagccgaaatggaattattatttagccgtcaacaacactttggtaatccattcgccagtgaaaaactcttagagaacttgaccgccttacttatgtggcaaaaaccagcactcagtggtgaagctatactaaaaatgctaggaaaatgcacctttgaagacgaatataaagcagccaaaaacacatattcagcagaaagattcgtatggataacaaaattaaataacctgagaatacaagaaaacgggctagaaagagcacttaatgacaacgaacgtctggcattaatggaacaaccttatgataaaaatagattattttattcacaagtaagatcaatactcaaattaagcgacgaagcaatatttaaaggactacgatatagtggagaagataagaaagcaatagaaacaaaagcagtcttaatggaaatgaaggcttaccaccaaatcagaaaagtacttgaggggaacaatctaaaagctgaatgggcagagctaaaagcaaatccaactctactagacgagataggcacagctttcagcctatataaaacagacgaagatataagtgcctacttggcaggtaaattaagtcaaccagtacttaacgctttactggaaaacctatcctttgacaaatttatacaattgtcactaaaagcactatataaactcctaccgcttatgcaacaaggcttacggtacgatgaggcttgccgtgaaatatacggcgatcattatggaaagaaaacggaagaaaaccatcatttcttaccacaaataccagcagatgaaatacgcaatccagttgttctacgtacactaacacaagcaagaaaagtaataaacggcgtagtaagattatatggaagtccagcacgaatacatatagaaacaggacgagaagttggaaaaagctacaaagatagacgcgaattagaaaaacgacaggaggaaaacagaaaacaaagggaaaacgctataaaagagttcaaagaatattttccgcatttcgcaggagaaccaaaagcaaaagacatactcaaaatgagactatacaaacaacagaacgcaaaatgcctatactccggaaaacccatagaattacatcgcttactagagaaaggatatgtcgaggtggaccatgcccttccatttagtagaacatgggatgacagctttaacaataaagttctggtattagcaaatgaaaaccaaaacaaaggaaacttaactccatttgaatggctagacggaaaacacaatagcgaaagatggagagccttcaaggcactcgtagaaaccagtgctttcccatatgcaaagaaacaacgtatactaagtcaaaaactagacgaaaaaggatttatagaaagaaaccttaacgacacaagatatgtcgcacgatttttatgtaattttatagcagataatatgcacttaaccggagaaggtaaaagaaaagtattcgctagtaatgggcaaataacagcactcttacgaagcagatggggactagccaaatcaagggaagataatgaccgacatcatgctctagacgcagtagttgtcgcatgctcaactgtagccatgcaacagaaaatcacaagatttgttagatttgaagcgggagacgtgttcactggagagcgaattgaccgagagactggagaaattatacctctgcatttcccaactccatggcaattcttcaaacaagaagttgagatacgaatattttcagataatcccaaattagaattagaaaaccgcctaccagatcggccacaagcaaatcacgagttcgtacaacccttattcgtaagccgaatgcctactcgtaagatgacagggcaaggtcacatggaaaccgtcaaatcggcaaaaagattaaatgaagggatctccgtaattaaaatgccattaactaaattaaaactaaaagacttagaattaatggtgaacagagaacgagaaaaagatctatacgatactctgaaggctagactagaagcgtttaatgatgaccctgccaaagcattcgcagaaccatttataaagaaaggaggagccatagtaaaatcagttagggtagaacaaatacaaaaatccggagttttagttagagaaggaaatggagtcgcggataatgcgagtatggtaagagtcgacgtatttaccaagggaggtaaatactttttagtaccaatatatacatggcaagtggcaaaagggatacttccaaacaaggcggcaactcaatataaagacgaagaggactgggaagtaatggataattctgcaacatttaaatttagcttacacccaaacgatctagtcaaattagttacaaagaagaaaacaatattaggctactttaatggcctcaacagagcaaccggaaacatcgatataaaagaacacgacctagataaaagcaaaggaaaacaaggaatattcgaaggcgttggaataaaactcgcattatcatttgaaaaataccaggtagacgagctagggaaaaatattcgattatgtaaaccatcgaaacgccaacctgttcggtga

SEQ ID NO: 4968 - RNA, 3168 nt, synthetic construct
  misc_feature 1..3168: note = Cas9 variant
  source 1..3168: mol_type = other RNA
atgaataattacatcttaggattagatatagggatcacgtcagtaggctatggcatagtcgacagcgatacaagggaaataaaagacgcaggtgtgcgattatttcccgaagcaaacgtcgataacaatgaaggacgtcgttcaaaaagaggagcaaggcgactcaaacgaagaaggatacaccgcttggatagagtaaagcatctcttagcagaatataacttactagatcttaccaacattccaaaatctacgaacccataccagatacgagttaaaggtctaaacgaaaagctatcaaaagacgaactagttatagcactcctgcacatagcaaagcgaagaggaatccacaatgtaaatgtcatgatggacgataacgactcaggcaatgagttatcaacaaaagaccaactcaaaaaaaacgccaaagcacttagtgacaaatatgtttgcgaactacaattagaaagattcgaacaagactataaagtacgtggagaaaaaaaccgattcaaaacagaagactttgtacgggaagctagaaaacttctagaaacacaatcgaaattctttgaaatagaccaaactttcataatgagatacatcgacctagtagaaacgcgaagagaatatttcgaaggccccggaaaaggcagcccattcggatgggaaggcaacatcaaaaaatggttcgaacaaatgatgggtcactgcacatacttccctgaagaactaagaagcgttaaatacgcatacagcgcagaactctttaatgccttaaatgacctaaacaacctagtaatcactcgcgatgaagaagccaaattaaattatggtgagaaattccaaataatagaaaacgtctttaaacaaaaaaaaacaccaaacctaaaacaaatagcaaaagaaattggagtatccgagacagatataaaaggatacagagtaaataagtcaggtaagcccgaattcactcaattcaaattatatcatgacttaaaaaatatttttgaagactcaaaatacctaaacgacgtacagctgatggacaacatagctgagataataacaatataccaagacccagaaagtattatcaaagaactaaatctcttaccagaattactcagcgaaaaagaaaaagaaaaaataagcgcattatcaggatacgctggaacacacagattaagcctcaaatgtatcaatttactgctagatgacttatgggagagttcattgaaccaaatggaattgtttacaaaattaaacctaaaacccaaaaaaatagacctatcccagcaacataaaatacccataaaattagttgacgatttcatcttatctccggtagtaaaacgagctttcatccaatcaatccaagtagtaaacgcaataatcgataaatacggacttccagaagacatcataatagaattagcaagggaaaacaatagcgacgatagacgaaaatttctaaaccagctacaaaaacaaaacgcagaaacacgaaaacaagtagaaaaggtactaagagaatatggaaatgacaatgcaaaaaggatcgtccaaaaaataaaactacacaatatgcaagaaggaaaatgtttatattcccttaaagacatacccttagaagacctattaaaaaatcccaatcattatgaagtagaccacataataccacgatcagtcgcctttgacaactcaatgcacaataaagttctagtacgcgcagaggaaaactcgaaaaaaggcaatagaacaccctaccaatacttaaatagctctgaaagtagcctatcatataatgaatttaaacaacatatactcaatcttagcaaaacaaaagacaggataactaaaaagaaaagagagtacctactcgaagaaagagacataaacaaatacgacgtccaaaaagaattcattaacagaaacctagttgatacaagatacgcaacaagagaattaacttccttgctaaaagcatatttcagcgccaacaacctcgacgtcaaagttaaaacaataaatggatcattcacaaattatctcagaaaagtatggaaattcgataaagaccggaacaaaggatacaagcatcacgccgaagatgccttaataatcgcaaatgcagactttttattcaaacataacaaaaaacttagaaatataaataaagtactagatgctccaagtaaagagatagataaaaaacgagtaacggtacaatctgaagacgaatacaaccaaatgttcgaagacactcaaaaagcacaagcaatcaaaaaattcgaaataagaaaattttcacatagagtcgataaaaaaccaaatagacaattaataaaagacacattatactcaactcgaaacatagacggcatcgagtatgtagtagaaagcattaaagacatatacagtgttaacaacgataaagtaaaaacaaagtttaaaaaagatccccatagacttttgatgtacagaaatgacccacaaacattcgaaaaatttgagaaagtcttcaaacaatatgaaagcgaaaagaacccatttgcgaagtattacgaagaaacaggagaaaaaatcagaaaattcagtaaaacaggacaaggaccctatataaataaaattaaatacctaagggaaagattaggacgccattgcgatgtaacaaataaatatataaactccagaaacaaaattgtgcaactaaaaatctactcctacagattcgatatataccagtacggaaacaactacaaaatgataaccataagctatattgatttagaacaaaaatcaaattactactacataagcagggaaaaatatgaacaaaagaaaaaagacaagcaaatagacgattcatataaattcataggatcattctacaaaaacgacataattaactacaacggtgaaatgtacagagtaataggagtaaatgatagcgaaaaaaataaaatacaactcgatatgatagatatatccataaaggactatatggaacttaataacataaagaaaacaggagttatatacaaaactataggaaaaagtaccacccatatagaaaaatacaccacggacatactaggcaatttgtacaaagcagcaccaccaaaaaaaccccaactaatatttaaacgaggcatggagtga

SEQ ID NO: 4969 - RNA, 3168 nt, synthetic construct
  misc_feature 1..3168: note = Cas9 variant
  source 1..3168: mol_type = other RNA
atgacgccaatttcggagtcactcttattcggattagatgtcggaattagttcatgtggatgggctgttttaaaacactctgacacaacagggcatatagaagctcttggatcttggtgtttcaatgcaccagaaacaaaaactgaacgaacaccaactaaccaaataaggagatcatccagattacttagacgagtagttagaagaaggcgaaatagaatgaccgaaatacgaagactatttgctagacatggtttaatagataatgatagaccagatgcactaagacaaccggctatagatccatgggagatgcgtggccaaggattggatagacaactaacaccagaagaattcgcagtggcactagcacacatagctaaacaccgaggatttaaatcaagtgccaaaagagtaaaaagcaatgcatcaccagatgatagtaaaatgttggctgcacttgaaaaaacaaaagaactttcagcacaatacagaacaataggagaaatgtttgccagagattccgcctatgtccaaaggcgcaggaacagagatggactattcgaccgaaccattagtagagatgacttaatcgatgaggctaaaatcttatttgatcgacaaagaaaattaggaaatcctgtcgcaagcactgaaatagaagaggcttttactaggatagcattctggcaaaacccaatgcaagatagtggcgtactggtcgcatcctgtccctttgaacccaaggaaaaaagatcctcacgatttagcccatcatttgaacggtttagactattgtgtcgacttataaatttgcgagtaacagatggtcctgaagaaaggccattaacggaagaagaattacgtttagcatatgagcacgcaggaaaaacaagaaaattaacagctgctgcaatacgaaagcttataggattaagagatgaccaacactttaccacaataccaccagaacaggaaaaacaagacatcacatccagaaccggcgagacttttgctggaacagcaacctttaggagtgtattgggagaaagcttatggcgacaattactgccacatccagaatggttagataatgcagcctggattataagttttcacgaactaacagaaacaataataaaaaaacttggcgaaataggcttgcccgtagaagcatatgaattaatatgcgatgcactaaaaagcgacaaaagcccttttgcaaaatttaaaggcgcatcttccttatctgataaagccgtgcgtgctttaatcccatacctacagcagggacttacatacgataaggcttgccaaaaggcaggatatgatcacgcggcgagtaggtttagtgggcgagctacgatagatacaaaagctaaatttaacgctcttatggcagaagtacgtgattcaatcgcaaacccaattgctcgaaaagcgctatcggaaggaatgaaacaactatgggcaatgagaaaccggtggggattaccaggtgccatttgtatagaattagctcgcgacgtcggaaacagcctagaaaagcgaaaagaaattgaacggaatttaaaaacaaccgctaaacaaagagcgagagaaagagaggaagcatgtgagttactaaatttaaaagaagtaagtagtgatatattattacgatatagactctggaaggagcaaggaggaagatgctgttacagtggtaaatcaataacaccagacatgctgatggcacaagataatcgaatacaaatagatcatattttaccatggtcaagatttggggacgacagctattcaaacaaaggactctgtctggcgaaagaaaaccaagcgaaaaaaaatcaaacaccatacgaatggattcatggtcaaggaacgacagcacaaaaagaacaatgggataaatttgttgctgatgtagaaagtagaaaaaacacaaagggcctaaaaaaacgaaatttcttactaaaaggttctaaagaaattgaggaacgattccgatcaaggaatcttaacgatacgagatatgctgccagacttatggtagaagcagctaggctattatatccggcaggacaaagaggagagaagggaggaacaagaagggtattcacacgacctggggctttaactgcagctctacgacatgcatggggggtagaatcactaaagaaaatagacggtgaacgattacatgataacagacaccatgctttagatgcagcaattgtcgccgcggtatcagaagctgaaatacaaaagctgactaaatccttccaagaatgtgaacaaaaaggactaagcagacccatgagagacgtggcaccaccatgggatggatttcgagaccaattaaaagagaaatatgaaacaatttttgtagcacgtccagaaaggcagagagcaagaggccaaggacatgaagcaacaatacgacaagtaagggaagaagaaacaggaccagtgatatacgagagaaaagcagtaagtgcactaacattagcagatctcgccaaaattaaagatccagatcgaaatgctggcttaattgcgagcctaagacagtggatagaagcaggcaaaccggcagataaaccaccacgaacaccctgccaccaatccgcagctgggcacgaaataagaaaagtcagattagcaacaataatcacaccagcggtgcctgtacggggaggtatggcaaaaagaggagaaatgactcgggttgacatattcaaagtaataggaaagaaaggaaaaccagaatggtacatgataccaatatacccacaccaaataatgaatcgcagtcaatggcctgcacctcccaacaaagcggtagtagcaggcaaatccgaagctgactggcctataatgggtgcagaagctcaatttcaattttcattatatccatgttcgtatgtaagactctttaaagaaggtacagtaatagaagggtatttctgtggatgtcacagatctagagcgtatataacacttgcattaagtacaggagctgctccactacaaaaaggcataggtataaaaactcaagaacatatacaaaaattttcagtaaacagatttggagaactctcacctgtcaaacaagagacgagaacatggcacggagtggcgtgtacctcaccagatcaacacgattga

SEQ ID NO: 4970 - RNA, 3171 nt, synthetic construct
  misc_feature 1..3171: note = Cas9 variant
  source 1..3171: mol_type = other RNA
atgaaagcactgaattatattttaggattagacctaggaattgctagtgtaggatgggcagtagtagaaatagaccagaatgagttacctatacgattaatagatctaggagtccgaacctttgaaagagccgaagtcccaaaaacaggggactcattagcactcgctcgaagattagctcgttcttcaagaagattggtaagaagacgagcagttcgactattaaaagcaaaaagactactcaaacaggaaggaatattacaagcagatgatttccacagtagtcacttaaaaccattacccaataacccatgggaattaagagtaaaaggactcaatcatttactcgacaggaaagaatgggctgctgttctattacatctactaaaacacagagggtatttgtcccaaagaaagaatgaaagtaaaacagacaacaaagagttaggagcactactgaaaggtgtaagtgaaaacagacaattactacaggcacaggctttcagtacacccgcagaaatagcaatcaagaaatttcaacaagaagaaggacatataagaaatcaacgcggtgcatactcacacacattcgacagaaatgatctcctggccgaacttaggttactttttcaaaaacaaagagaatttaataacccatatacatctcaatcgttagagcaagcgatagctgaactattaatgtggcaaaaaccagcactaagtggagaagctatattaaaaatgcttggaaaatgcacttttgaaccaagcgaatacaaagcgcctaaaaacagttactcggctgaatactttgtctggctaactaaactaaacaacttaagaatactagagaatggcgcggatcggggactaacagctgaagaaagacaattactgataaatcaaccattcgaaaaagcaaaatttacgtacgcacaagcacgaaaacttctagaactttcagatctagcaatatttaaaggtgtaagatacggaaaagataatgccgagagcgccacattaatggaaatgaaggcttggcacgccataagaaaagcgttggaatcaaatggtctaaaaacagaatggaatggcttaaaaaccaaaccagaattactcgataaaataggaaccgctttctccatttacaaaactgacgaggatatatcacaatatctaaatggcgaattaagtccagccgtattgaacgcattattagaaaatctcagctttgataaatttataagacttagcttacaaagtttggccaaaatactcccattaatggaacaaggattaagatacgatgaggcttgtaaacaagtatacggggaccactacggaaagaaagaacaacttgagttaaggtttttaccaaaaataccagttgaagatattagaaatccagttgtattacgaacattatcacaagctaggaaagttatcaatggtgtcgtaagattatacggaagccccgcaaggattcatattgaaacagggagagaagtgggaaaatcatttagcgaacgcagagatataagtaaaaggcaagaagagaacaggaatgaaagacaacgagccgtagaaaaattcaaagagttcttcccacatttcgttggtgaacccaaagcaaaagatatattaaaaatgaggctctacgaacaacaacatggaaaatgcctatattcaggtaaagaattagacttaaacagattactagaaaaaggatacgtagaaatagatcacgctttgccatttagccgaacctgggatgattcctttaataataaagtattagtcctagcgtcagaaaatcaaaacaaaggaaatcaaactccctacgaatggctcaacggcaaagaaaatgcagaacgatggaaactattccaggctttagtaaacggaagtagattcccatacagcaaaaagcaaagaatactcactaaatatctagacgaagatggattcagagaaaggaatttaaatgacactagatacgttgcgaggtttctttgcaacttcattgaagataatatgcaattagtaggtcaaggtaagaaacgagtatttgcgtctaacggacaaataactgcactattaagaagatcatggggaatacaaaaagtaagagaggataatgatagacatcatgcagtcgatgcagtcgtagtagcatgctcaactagagctctacaaaagaaaataacagactatgttagatacaaagaaatgaatgtattcacgggagagaaaattgatcaagaaacaggagaaataataaaatttcattttccagaaccatggaaattcttccgacaagaagtcgaaataagggttttctcagagacaccagcagaagacgtagtaatagcacttccagatagaccacaagcaaatcatgagttcatacaacctttatttgtttccagagcacccacaagaaaaatgacaggccaagggcatatggaaaccataaaaagtgctaaacgactcgccgaagggctgtcagtaagtagagtaccgctaacccaattaaaactaaaagatctggaaaatatggttaaccgagaacgcgaaaaagcactctatgaagcactaaaagtaagacttgaaaaatttaacaatgatccagcaaaagccttcgcagaccctttttacaagaaaggcggacaacaagttaaagctgttagagtagaacaagtccaaaaatcaggggtcttagtgagacaagaaaatggcgtagcggacaacgctagcatggtacgtgtagacgtcttcataaaaggaggaaaatacttcttagtacctatatatacatggcaagtagcaaaaggaatattacctaatcgcgcagcaactcagggaaaagaagaagaatattgggacatcatggatgaaacagctatattccaatttagtctatatcagaatgatttaataaaactcgttaccaaaaagaaaactattttcggatactttaacggactaaatagagcaacatccaacataaatataaaagaacatgacctagacaaaagtaaaggaaaagacggaatatatctagaagtaggagtaaaattagcactatctttagaaaaataccaagtagatgaactgggtaaaaatatacaaccatgtcgaagtatgaagaaaagaccacccgtcagatga

SEQ ID NO: 4971 - RNA, 3171 nt, synthetic construct
  misc_feature 1..3171: note = Cas9 variant
  source 1..3171: mol_type = other RNA
atgcccaaacagaaaagtacaagatatagactggcactagatttaggaagtacaagtctgggctgggccgttttaagactaaatgaacaacatgaaccaaacgcaatcataagagccggagttagaatatttagtaatggaagaaaccctaaagacggttcatctttagctgtaaccaggcgagcggctagggccatgagaaggaggcgagacagacttctaaaaagaaaagcgagaatgatgaacaaacttgtggaatacggattctttcctgccgacgtagcagaacgaaagaaactagaaaggattaacccatacgaattacgtgcaaaaggactagatgctccactaacaccgggagagtttgcaagagcattatttcatataaaccaaagaagaggattcaaaagcaaccgtaaaactgataagaaagaaaatgattcaggagcactcaaagcagcaatttcccatctaagacaacaattacatgaaagaaaagcaaggacagtgggtgaatggctatggcaacgcttgcaagcgggacttggcacaagagcaagatacagggaaagcagggttgcacaagcgaatggaaaaacaagaatagagaaaagttatgacctctacgtagatagacaaatgattgccgaagagttcgacgcactttgggcagctcaagctgcatttaatcctcagcaattcagcgaacaggctagaggagaattacgagatgtcctactgttccaaagagatctgagaccagtaagaccgggtaggtgtacattgttacctgatgaagaacgagctccattagcgttaccctcagtacaaagattccgaatattacaggaagcaaatcatctccgattactacacccagatctaagagaagaaccactttcgttggcacagagagatgcagtcgtggatgctttagaacataatagtaaacgaacttttgaacaactaagaaaattgcttaaacttaatggaacagtcaaatttaaccttgaagacgaaaaacgtaaagaactcaaaggaaacgccacgagcgctacactatcgaaagatgggttgtttggcgaaaattggtggaacttagatgaagcactacaagacgcaatagtatggcaattagtatcagaacaatcagaagaaaaactacaaaactggttacaagccaacacaggtgtaaatgcaacacaagcagagactatagccaatgcagggctaccggaaggatatggatcactctcatacaaagcacttgcaaggatcataccagctttacgtggtacggaagtagcaaatggaatagatgtaccaagaacatacgaccaagcagtacaagctgcaggattcgcccatcattcggacttagattctggattcgacttcgaacactcacatgatgaagttgaacgaattggagaacgagtaatagcaagtacaggagaagtaaaaccagtatttgcatttaaacaattaccatattacggtaaagcattaagaagacacgttgcgtttgcaaaagaacatccaagaaacgaagaagaacgatatggaaaaattgcaaatccaacagttcacatagggttaaatcaattgagggttgtagtaaatgcattgattaggcgttatggacgcccaactgaagtcgttgttgaactagcaagagacctaaaacaaagtagagaacaaagacaagaagaacagaaaaggcaagctgactatcagaaaaggaatgaacatatcagacgagaaatagcgagcatgcatgggtgcgctgaagaaagggttagccacgcagatgttcaaaaatggatactgtgggaagaattaagttttgacgtagcagacaggaggtgcccttattcaggggttcaaataagtgcgcaaatgttattgagtaatcaagtagaaatagaacacatattacccttttctcaaacactagataatagtttaaataatcgtacagtagcaatgagacaagcaaataggataaagggaaatagaactccatggcaagcacgagaggatttcgaaagacaaggctggagttatgatagcatattacaacgcgctgaacgaatgccgaaagctaaacgatacagattttcaagggatggatatgaacgatggttaaaagaagataaagactttttagcaagagcattaaatgatacaaggtatttatcacgtgtcgcaaaaacatacatggaattggtctgtcctttaggtactagagtcataccaggacaaatgactgccctgctaagggctaaatttggattaaatgatgttttaggtttaaacggagagaaaaaccgagatgatcacagacaccatgccgtagatgcatgtgtaattggggtgacagatcaaggtcttctacaaagatttgctcaagcatcagcggatgcaagaggaaacggactcgaaaaactggtagaaaacatgccagtcccatgggcaacctatcgagatcatgtaaaaagagctatacaatgcatctgggtttctcataaaccagaccacggttacgaaggacccatgatggaagaaactgcatatggtattcgaaaagacggaagtatcagacagaaaaccaaagcagatggttcaactgggcgtgaaattacacatttaataaggataacagaacctacacaaaatttaagacacggagtcgatgcacaaggacaaccacttgcttataaaggttatgtaggtggatcgaatgattgcatagagataacacagaatgaacaaggaaaatgggaaggaaatgtaattacaacatttcaagcatatgatatcgttcgtagattagggtcaaaacaaggcccacgtcgacttagacatcccacattagcccaaacattagatgtatatggtaaaccaaagaagctagtgatgagactaatgattgatgattgtgtccgcctagagttagatggaaataagaaaactttaagagtagttaaaataacaggaaatggtcaagtttttatggcaccagtacatgaagctaatgtggataaaagaaatagtgataaaacagatccatttgcatacgtatctaaatatgccggatcatttcaaaaagcaaaagctagaaggatcacaatttctccaattggggaactccatgatccaggattctga

SEQ ID NO: 4972 - RNA, 3174 nt, synthetic construct
  misc_feature 1..3174: note = Cas9 variant
  source 1..3174: mol_type = other RNA
atgtctgataaaagtaaaatactaggatttgacataggaataacatctataggctgggcatacgtagaaggagaagaactgatagactgcggagtgagaatattcacaaaagcggaaaaccccaaaacaaaagaatcgttagcgctacccagacgtgaagcaagaggagtgagacgaagacttgctagaagaaaaggaagactaaacgcaataaaacaactcatttgcaaagagttcggattgaactatcaagactacatagcacaagatggagaactaccgaaagcatatgctggaaaactcataaacccctacgaactaagaagcaaagccctaagagaaaaacttgaaaaagaagaattagcaagagtaattctccacatagccaaacacagaggctacggaaacaaacatgcaaaagaaacagacgacgccgaaagcggcaaaatcaagaaagcgattagtaataacgagaaaattctcaacgaaaaaggataccaaagtgcaggcgaatatctctaccaagaatttttccaaaaagaacgactacaagaagagaagaaaggcaacaacacaacaaaagagttcaaaaatgtgcgaaacaaagccggcgactacgaacactgtattgctcagacacaaatgcaaaacgaactaagacttatatttgaaaaacaaagagaatttggattaaacttcagcgaagaatttaaaaagaaagtattggaaaccgcattcttccaaagacccctaaaagatttctcggataaaattggagattgcacattcatcgaaggagcgaaaagagcgccaaaagatagcttatctgcgatagaatttgtcgcattaggaagaataatcaatacacttaaaaatctacaaaacacaagtggagaagtgtattccagagacaaaataaacgaaatactccaaatagtattagataaaggagaaataagctacaagaaattaagagaaatactagatatcgaaagttcagtaagattcaaagactcaaaattagactacacaaaagaacttaaagaagctgagaaaacaaaattatttgaaagcaaaaacttacaaaaatttaagaaagcactaggaagttttgaaggaataagcagggaaatactagatagcatagcgaaagaaataatgataaccaaagataaagaaaaattagcaaaagaactcaagaaatttccattagatgaaacccaaatacaaaatctgagcaacttaagttttagtcaaacaataaacctatcattggaagcgctatcgcaaatacttccattcatgagaggcgaaagggaagataaatgcctaagatatgatgaagccgtagaaaaagcaggcctaaaagaagtagccaaaaacaaaagtaaagacgacttcctcccaccattagaaaattacgaaccctacctcgcgaatccagtcgtagctagagccctatcagaatatagaaaagtattaaatgcactgttaaggaaatatggcaaaatgcataaaatacacatagagttcacaagggaagtaggaaaaagtaaagaagaacgaaataaaatagaaaaagaacagaaagaaaacttcgcaaagaaccaagaagcacagaaacagtgcgaaatacttggactgccaataaacggagctaacatcctcaaaatgaaattgtggcgtgaacaacaggaatcatgcgtatactcaggaaaggaaatagctatagacgatctaaagaacccagcaatattacaagtcgaccacatatatccttactcaagatcattcgacgactcttacaataacaaagtactcgttttctcaaaagaaaaccaaaataaattgaacaaaactccgtttgaagcctttggagaaaacaaagataaatgggagaaaatattaagccttgctagtaagctaccgaaaccaaagcgacaaagaatatacaacatgcaattcaaagataaagaacaaggctttttaacacgaaatataaacgatacaggctatatcgccaggctagtatctcaatggaccaaaaactgcttatcctttgaaaaactatcagaagatgaagtctccatagcaggcgaaaaaggttcaaaggtgcatgtagaagtaataagcggatcactaacagcgatgttaagacactattggggactaggagataaaaacagagacaaccacttacatcatgcagtagatgcaataataatagcgtattcaaacgaaaaagttattaaagccttcagcgattataagaaacatagagaacaaaataaagcaaaattctatgcgaaagaaatcgcagaatcagaatacaaaaagcagaaagtattcttcgaacccacaaaccacttcaggcaaaaagtcctcgagaaaatagattcaatattcgtaagcaaaccacccagaaaaagagcaagaggagcactccacgaagaaacattttatagcttcgaaagattatgcaatgacaaagaatatgcgaagaaagagaaaatggattacggaggaaaagcaggaatacaaaaagcaatagccctcggaaaaataaggcaagttggaaccaagatagtttcaaatggaacaatggttagagtagacatctttcaacacaaatcaaatggaaaattctatggagtaccaatatacactatggattttgcactcggtgtactaccaaacaaagcagtagtatcaggaaaggataaacagggagttataaaagactggttagaaatggatagcaactatgagttctgctttagcctatttaaagacgacttaatcctagtacagaagaaagaaatggagaaagccgaattatgctattacacagacttcaattctaatacggccggcataaaattcgaaaaacacaacaacttatatgtaaatctcaatgaaaatgaacgcaagctattcacaagcaaagaagtcgtaaaaggaggcaagaaaaacgtatggaaagataaaactcctaaagaaatagaacaactcgagaaaaacagaaaaatcattggaggatttgtaaccatagaagatctcaaaacttttgaaaaatatcaagtttcacctttaggagaagtacaaaaagcagatttcgccccaaggcaagccataactctaaaatcaagtccaaaacatcgaataaacaaatga

SEQ ID NO: 4973 - RNA, 3174 nt, synthetic construct
  misc_feature 1..3174: note = Cas9 variant
  source 1..3174: mol_type = other RNA
atgagcaatcgggtaccatatagattggcattagatttgggaacaaacagcattggatggtgtttactagacttaaacgggaacggtgacccatgcggtgtaaggcggatgggggtacgaatatttcccgatggaagagaccctaagtcaaaggaaagtttagccgcggataggagattagctcgatctatgagaaggaggagagaccgatatcttcgaagaagaagtgcattaatgaatgccctagtggcggcaggtctaatgccggcagatagagcaacaagaaaagcattagagtcggaagatccatgtgaactacgagcaagggcattatttgaaccattaacagctgggcaggttggtagagcattatttcatttaaatcaaagaaggggatttaaatcaaatcgtaaggcagctggtgaagaaaatgaagcaggaaagataaaagctggaataagtgcattaaaagccgaaatagaagccagcggcgaaactactttaggagcttggttagctgccagacatcgaaaaagagagaccgtgagagcgagactggacggcgcgggagcaaaagcaagctacgaattttaccctgaaaggggattagtacatgacgagttccaggctattagaactgcacaggcacttcatcacccagcagttacggcagaacaatgggatagagtcgaaagcgtgattttcagacaaagacctttacggccggtccgaccaggtaaatgtacgttattcccagaccaagaacgagcaccatgggcactaccagtggctcaagaatttcgaattttgactgaaataggtaatttaaaactgtatagaccaggcgaagaacctcgtgaactttcggctgatcaacatgcacagctctttgcgaaattgtgcagatcggcggatttgacatttgagaaaattcgaaaagaattaaaattggatccaggactaaaagttaatctagaaggagagaaaagagatagacttaaaggagatgcagtcacgagtgctctctcagctaagaaacggtttggtcccaaatggaatgctttaactccggacgacagaagagatattgtcggaagacttatagaagcagaagatgaagcagaattagcaggatggctagagagtgttcacggacttccaagcgagaatgcagcacatactgcagcaagcccaggattaccagacggctattgtaggctatcagagaaggccctagtaaaattagtacctctaatgagagaacaaaggctcaggtacgatgaagctgtactggcattaaacttgcatcactcagatttccgacctgaaggtttacttgacgaattaccatattatggtgaaccactagaacgatttatagcttttggaagtggagaaccctcagacccaccagaacaacatcttggaagatttcctaatcccacagtacatattggattaaatgaacttagaaaacttgtaaatcgcatagtagaaagatggggtaaaccggcagatattgttgtagaattagctagggatttaaaaagatctagagatgagagagacaccatccagagagaacaagcacagaaccaacgtaaaaacgaagacagatttgcaaaaataaaggaattgggcatagacccaagaccggatagcatgctaaggctacggctatgggaagaattgccgaaagtaggagttgggcatgtatgtgtatacacaggggaaccaattggtattagaagactattggaaggtgacgtagatatagatcacattctaccgtttagccgtaccttatcagacggcgccgataacaaaattgtatgtgtacgtagagcaaatagatttaaaagggacagaagcccatgggaggcatttggagtaacagctgtagatggatatgattgggctgcaatagcacaaagagccgaagaactgcctaaaaataaacggtggagatttttaccagacgcaatggatcgatttgaaggggaacgaggtttcttagatagacagctagtagaaacaagacatttaagtcgagtggccagacaatatttagcttccatcgtcgacttaaacaaagttcgcgttgcaccaggaaaactaacagccatgcttagagcacgatggggtctcaataaaattctttcagatggaaatttaaagaataggtcagatcatagacaccatgcaatagatgcggctgtgttaggaatgatagatcaaaggctagtacaattagtagcacaagctgcagcaagagcagaagcgaatgaacttgaaagactatttgatggactcccagatccatttgacgggttagcagcaacatcatttggagatcaagtaagggagaaaatcagaggaataactgtaagtcacagggcagaacacggttggcaagggagaatgcataacgacaccgcttatggtccggtggaggctgttaacggcgtccatacggtagtaaccaggaaacctctatcaggactaacagcaaaagatttcccaaatatcagagatagggttttggcgaaagcactagaagatcacgtagcagcggaagcagccgctggtaggagctttggagatgcattaggatcatttaaatggggaggacaaccagtacgaagagtaagaatgttagatgtgctaggaaatcctataccaatacaagatccatctgggaccgtttttaaagtgtataaaggagattcaaatgcctggtatgaaattttgagggatcccagagggagatggacaggaaaaatagtaagtacttttgaagcatacaggttacatagagagtggttagcagaaaccggaggagattctggaagaggctcaggagtatttttagactgggccgcaaaaagggtagtaggtgaagcaggaacacctttgtttagattgttcaaaggagacttactagctcttggagaagctccagatagaagaatagtaagagttgtcaaattctcggaaggacaggttgcactcgcacttcatttagaagctggtaatctaaaagccagggacgcagataaaggtgatccatttaaatatcaatattgcagcccagactcattaagaaaacaggcggcaagaccagctggagtagatttactaggatatgttcatgataaaggaccgctcgaatga

SEQ ID NO: 4974 - RNA, 3174 nt, synthetic construct
  misc_feature 1..3174: note = Cas9 variant
  source 1..3174: mol_type = other RNA
atgcgaaggttgggtcttgacatcggaacaaatagtattggttggtgtttaatagaagatgacaagaaaatagtcgacataggagtgagaatcttttcggacggacgtgacccaaaaagtggagcgtccctagctgtagacagaagagatgctcgtgcaatgcgcagaagaagagacagatatttaggacgaagaagtgcattcttacaagctctagtagtccatggcttaatgcctgctgacgcagatgaagctaaattggttgccgatagagacccataccaattaagagcaaaagcattacatgtagctctagagccatttgaaattggtagagcattatttcatttaaaccaaagacgaggattcaaaagtaataggaaagcagataggaaagcaaacgcaggggaagacggtaaaatagctgaaggagcaaaagctctagatcaagcaatgtctgaagcaggagtggatactttaggtcaatttttagctttaaaagaaactaaaagagtgcgcttaggaagtgatggtcaagcatatgatttctatccacaaagaagacacatagaatatgaatttgataggatatggaaagtacaatctgaataccaccctgccttacttacagaagcggccagagcagcactacacagaatactattctttcaaagacctttaaaagcacaagaagtaggattttgtacttttgccggagtcaatggtatagcagcaaatgaacggcgtctaccaaaagcacacccactgtttcagcagagaagattatacgaagaagtcaatcaattacgtattgtatctgcaggagcagcagatagaccattaactttagacgagagagataggctaatattacgactacaagatagaaagaaagttagctttgatacgttagcaaagaaagatttaagacttgcagatggcgaaagatttaataaagaatcagaaaatagaaaagagttaatcggagacgaagtacgagcagaaatgtcagataagaaaaggtttgggacaagatgggtacactttggactagatgagcaattaaggatattagcaaaattacaagatgaagaaaacccagaggcactactagattggctgaggagtgaatacggtctggatgaagctgcagcagaatcagttgctaatgccagattaccagaaggatacggaagatttggagaaacagcgacacgtcttctattagatgccctaaaagccgaagtgataacttatgacaaagcagcattgagagcttttgggcatcacagcgatttccgtacgggtgaggtactagatcgcctaccatactatggagaattactaaccagagagatagcaccaggaaaacctgaatatggagatccattagaacgacaatatggtaaaataactaatccaactgtacacatcgggttgagacagctagaaaaattagttaacgcagtcatagctgtgcacggaagacctgatcaaatagtagtagaattagcgcgagagctcaaacttaatgaaaaagaaaaagatgagcataaacggagaataaaaagagatactgatgcagcaatagctagagggagaaaactagcatcagaagggtttatcgataacggagcaaatcgaatgttaatgagaatatgggaagagttgaatccagctaatccattagacagaagatgtccatattgcgcagaacccataggaataagagcacttttctcgggagaagcagatatagatcatataataccatatagcagaagtttggatgataacgtaggtaataaagtcgtagcacatagaagttgtaaccgagcaaaagggaataaaacaccatatgaaaaatggggtccacacatagatccagaaagatgggaaagaatttcagatcaagtagcgaggttacataaatcgaaacaatggcgatttggaccagacgcgatggaaagaatagatcgagacggtggatttttagcaagacaattaacagatacccaatatctttcgagggtagccggaaaatatctcagaagtctatatcccacagcacaaagtggaagagttgatgtaatacctggtagaatgaccgctatgttaagaagaaaatgggggctaaactcattacttccagaccataattacgtggaaaatgaacactcaaatgcacccaaaaatcgattagaccatcgtcatcacgcgatagatgctgcggttgcagccgttacaactttgtcattaatgcaacaaatagcagatgctgcaggacgcgcagaagacaaaaatttagatcgactcttcgaagatataccccagccttggccaggatttagagaagaattaggcgaggcattaagatcaactacggtaagtcacaaagcggaccacgggagaaaacgacgtccttccagggatagagatgtcacggctgctagactacataatgatacagcatatggtttaacaggtgatgtagcagcggacggaaaaacgccaattgtagttcatagagtgcccttagctagcttaaaacctgctgatttaattgacccgttgaggattcctgatccagttctcagagacgccttatatgcagcaacacgtgaccgaacaggaaaagaatttgaacaagccctaacgcaatttgccagacatcacccactatttaaaggtataaggagagtgagagtaagggaacccctaaatgtaatcccgatacgagacgcggcaggcagggcatataaagcatataaaggtgacgctaatgcacgatttgatgtctggagactaccaaatggaaaatgggtttcagatatagtatccatgtttgatgcacactgcatggctgacaaatccgatagaaggccacacccggctgcaaagaaagtactatcactaagacaaaacgatatggtagcaattgaaagatcgggtgtaacacaaatagcccgcgttgtaaaattttcaacgaacggtagtatagcactagctgccgacaacgaagcaggagcacttaaagcacgtgatgctgctccaaacgacgtggatccatttaaatatatattttcatcaggtggaggacttaaaaacttaaaagctagacaggtaagagttgacccattaggaagagtatttgacccaggaccaagggaatga

SEQ ID NO: 4975 - RNA, 3177 nt, synthetic construct
  misc_feature 1..3177: note = Cas9 variant
  source 1..3177: mol_type = other RNA
atgaaaaatagttacatacttggactagacgtcggaatcgcaagtgtaggatacggcttaatacattcagactcaaaatccgtaatagacgccggagtacgactatttccagaagcaaatgtagaaaacaacgagggtagacgagctaaaagaggcagccgacgactaaaaagacgcaggatacataggctagatagagttaaatacttacttgcacaataccacctgataattgacgacaaaataccaaaatccacaaatccttatgctatccgagtaaaaggattatcatcagcactttccaaaagcgagttagtaatagcattactacatctcgcaaaacgaagaggcatccataacgtaaacgtagtcatggacgaaaacgaatcgaccaacgaattatcaacaaaagaacaattaaaagaaaacgctaaacaactagaaaatagatacgtatgcgaactacaattagaccgattaaatgaacaatacaaagtcagaggcgaaagaaacagattcaaaacagaagactttgtcagagaagccagacaaattctaactacccaacaaaaatatcacgacatcgatgaacacttcatagagcaatatacacacttactagaaactagacgagaatattatgaaggaccaggaaaaggctcccaatacggatgggaaggagacttgaaacaatggtacgaaatgttaatgggtaggtgcacatactttccagaagaactcagaagcgtcaaatatgcttacaccgccgacttatttaacgctcttaacgatctgaacaacctagtaatcgcacgcgatgaaaatgaaaaactagaatactttgaaaaataccatataatagaaaacgttttcaaacaaaagaaaagtccaacactaaaacaaatagcaaaagaaatagacgttaaagaatctgacatcaaaggctatcgcataactaaaaatggcaaaccccaattcaccagcttcaaactctaccacgacctaaataaaatattcctagacaagaaaaatctagaaaatatagaactactagacgaaatagcatttatactaacactctaccaagatccccttagcattaaagaggctttagaccaactccaagacctactaacagaatcagaaaaagaagcaattgcacatctcaacggctacaccggtacacaccgactcagcctcaaatgcttacatttgctgatcgatgaaatgtggcaaaccagccgcaaccaaatggaagtattcacagcattaaatctaaaacctcaaaaataccaactatcgaaacagaaacaaatccccaagaaaatggtcgaagaatttatacttagtcctgtcgtaaaacgatcttttatacagtcaatagaaatagtaaatacaattataaagaaatacggattacctgaagaaataataatagaattagcgagggagaaaaattccgaagacagaagaaaatttcttaaccgcatacagaaagaaaatgaaaacacaagaaaacaagtagaagaagtaattcgcgaatatggaaacagaaacgcaaaaggattagtcgagaaaataaaattgcatcaaatgcaagaaggcaaatgtctatacagcctccaaaacataccgctagatgacctactaagaaacccatcacactatgaaatagaccacataataccaagaagcgtaagtttcgacaatagttttaataataaagtcctagtaaaacaagaagaaaacagcaagaaaggcaacagaacaccctatcaatatctaaactcaaatgaaagtgtactgtcatacgtacaattcaaacaacacattctgaatctttcaaaaagcaaagaaagaatcagcaaaaagaaaagagaatacctattagaagaacgtgacataaataaatttgaagtccaaaaagaatttataaatcgaaacctagttgacacaagatatgcgacaagagaattagtacaactactaaaatcatatttctcagcaaatgacctagacgttaaagtgaaaacaataaatggctcattcacaaactacctacgtaaagcctggaaattcgacaaatctcgaaataaaggatttaaacaccacgcagaagacgctctaataatcgcaaacgtttcatacttattcaaacaatccaaagaacttaaagaagccaacgcaatactcgaaaacaataacctcagtctaaataaaaataaagatagtaaaaaccttttaaccgaacaagactatagaaaaatgtttgaaattccaaaacaagttcaagatataaaagattacaaagactttaaatattcacatcgagttgataagaaaccaaaccgacaacttataaatgactccttatatagcacaagagaagtaaacgaaaatcactacatcgtacagacagtaaaagatatatatgcaaaagacaacaccaaaataaaagatttattcttaaaaactccagaaaaactattaatgtatcaacacgatcctcaaacattcgaaaaactcatgctagtcataaaacaatatggagaagagaaaaacccgtttgccaaatactatgaagaaaatggtgaatatcttactaaatatgcaaagaatgaaaaaggtccaactataaaacgcttaaaatacataggtaagaaagtaggaacacacttagacatatccacaaatttctctggggccaaaagaaaagtcgtgcaactctcaatcaaaccgtttcgtttcgatgtctttcactccaaagcaggatatcacatgctcaccttaacatacatggatatcaaaaagaaagaaaaacattaccaaatactgaaaaacgaataccaagcactaaaagaaagatacaaagtgccatcagacgctcaattcataggttcattctattacaatgatctaatatcaataaatgatgaactattcagagtaataggagttaataactcaacaagaaacgtagtcgagttaaatatggttgatataaattacaaggattattgtgatctcatgggaattaagaaaaccccacgaatattcaaaactataacaaagaaaacaggaaaaatcgaaaaatactccactgatatattaggaaaccagttcaaagtaaaaccatccaaatcaccccaactcatattcaaaaggggtgtcttatga

SEQ ID NO: 4976 - RNA, 3180 nt, synthetic construct
  misc_feature 1..3180: note = Cas9 variant
  source 1..3180: mol_type = other RNA
atgaggcgactcggattggacattggtacaaattcgataggatggtgtttaacgcaaggcccgggagatgaagcagacggaattgtcgatataggagtacgtatattttctgacggaagagatccacagagtggaacttcgttagctgtagacagaagagatgcgagagccgcaagaagacgaagagaccggtatattggtagaaggagcgcatttctggatacgttagtagcacacggattaatgccagcagatgctgatgaagctaagctagtagcagctttagatccatatactcttagggcccgagcattagaagcacctttaacacctcatgagataggtcgagcattatttcatttgaatcaacgtagaggttttaaatctaatagaaaagcagaacggaaaactaacgacgctgacgatggaaaaatagcaacagcagcatatgcgttagacagggcaatgttagatggaggatttgatactctagggcaatttttaaatgctcaagaaacaaaacgagtaagaatggatggagaagcacagggttacgatttctatcctcaaaggagacatgtcgaatatgagttcgataggatctggacagaacaagcaaaacatcatccagcattattaacagaaacagcgcggtatgcactacacaggatactattctaccaacgacctcttaaagcgcaagttgtcggtaaatgcacctttgtccattctgaagatagattagcaaaagcacatcccttatttcaacaaagacgattatatgaagaagtaaaccaattagaagttacaacaccaggagaagctaatagaaaattaacactagacgaaagagacagattggtaagagaactcagccataagaaagcgatagcatttacttcgttagcagcaaaaataaaattagaaccgggccaatcctttaataaagcgtcagaaactcgaacacaattagctggagatgaggtaagagcagtattaggggataagaaaagattcgggccagcctgggaacattttgacagggacaggcagtggacaattgttgaaagattattggaagaagaagatcccgacgcacttcacgcatttttaacccaagactgtggtttagatgatgaacacgctgccgctactgccaaaacaagtttacctgaaggctacggaagactgggagctacagcaacagcgagaattttagcagaacttcaagcggaagtcatcacatatgacgaagctgtacgccgatgcgggtggcatcattcagatcatagaaccggggaaatattacctcaattaccttactacggcgaactattaacaagggatatccctccaggtacacaagatccaaacgacccacctgagaaaagatgggggagaataacaaatcctacagtccatattggtttaaaccaagtacgacaattagttaatgctatagttgcagtacatggtagaccagatcaaatcgttgtagaactagcaagagaattaaaattaaatgaaaaagataaagaagaacataaccgaagaatcagacgcgatacagcagcagcaataaaacggtcagaaaaattaacacaagaaggttttccagatacaggcgcaaacagaatgctactaagattatgggaagacctaaatccggcgaacccactagacagaagatgcccatattgtggagccccaattggaatgagagcgttatttgcaggagaagctgatgttgatcatatcataccctacagccgaagtttagacgattcagctggtaataaagttgtagcacacagaagttgtaatagagctaaaggcaatagaaccccgtacgaaaagtggtcagacgatccagatagatgggacgcaatcaccgcacaagtagctcgactacaccgaagtaaacaatggcgttttggaccagacgcaatggcacgagtagagaaggatggcggatttttaagtcgacaattaacagatactcaatatttatcacgattagcaggtaggtatttaagtagcttatacccaacaaaagaggaaggtagcgtatatgtgataccaggacgcatgaccgctatgttgaggagattgtggggattaaacgatatattatctgaccacaatatagtggaaaacaagcactctaacgcacctaaaaacagattggaccacaggcaccatgctatcgacgcagcagtagtagctgtttctacaagatcccttatgcaaagaatagctagaactgcaggacaggcagaagatcgtaatctagaccgattgtttgaaggccttgatccaccatggcccggctttagagatcaattaagagatagattgctggcagtcacagtatcacataaagcagatcacggaagaacggggacaccagtacccggaaaagatgcaactgcaggaagactacataatgacacagcatacgggctcacaggcgaaaccagtgcaaaagggttaccaatagtagtacatcgcgtccctctaacaagccttaaaccggcagacatcacggaccccgatcgcatacccgatccagtactcagagacgcaatcgaacgcgcgacagcaggcaaaatgggaaaagactttacagacgctctagcgaaattcggaagaagtggagcgcaagagacagatcgaaaaggagaacgtctatttagaggaacaagaagagtaagagtgagagaacctttaggggtaattccgatagctgatgccagtggaagagtatataaagcatacaaaggagacagtaatgcgcgatttgatgtatggcgattaccagatggaaaatgggtctccgatatagtttcaatgtttgacgctcacagacccgaccaaggtgatagaagaccccatccagcagcgaagaaagtattaagtctaagacaaaatgatatgattgcaatagagcgtgatggagcacccagagaaattgtacgcgtagtaaaattctcaactattggaagtgtgcaacttgcagcaacgactgaagcaggccccctaaaagccagagatgctagtcccccagacgtagatccttttcgatatattaattcaagcgcgggaggtttaaagaaaattaaagcaagacaggtccgaatagatcctttaggccgtatatttgatcctggtccgagatga

SEQ ID NO: 4977 - RNA, 3180 nt, synthetic construct
  misc_feature 1..3180: note = Cas9 variant
  source 1..3180: mol_type = other RNA
atgatagaaagaatattaggagttgatttaggaatatcaagcttaggatgggctatagtagaatatgataaagatgacgaggcagcaaacagaatcatagactgtggagttaggttattcacagccgcagaaactcccaaaaaaaaggaatcgccgaacaaagccagaagggaagctaggggcatacgccgagtattaaatagaagaagagtccgaatgaacatgataaaaaaattgtttttacgagctggacttatacaagatgttgacctggatggagaaggtggaatgttctactcaaaagcaaacagggcagatgtatgggaactaagacatgatggattatacagacttctgaaaggagacgaactggcaagagtactcatacacatagcaaaacatagaggatataaattcatcggggatgatgaagcagatgaagaatccggaaaagtcaaaaaagcaggagttgtactaaggcaaaacttcgaagcagcagggtgcagaacagtgggtgaatggctatggagagagagaggagcgaatggaaaaaaaagaaataaacatggagattacgaaataagtattcacagagacctactagtggaggaagtcgaggcaatttttgtagctcaacaagaaatgagatcgaccatagcgacagacgcgttaaaggctgcatatagagaaatcgcttttttcgtaaggcccatgcaaagaatagaaaaaatggttggtcactgtacatacttccccgaagaaaggcgagcgcctaaatcagctccaacagcagaaaaatttatcgctattagtaaattcttttcaactgtaattatagataacgaaggttgggaacaaaaaataatagagagaaaaactctagaggaacttctagattttgcagtttcaagagaaaaggttgaatttagacatcttcgtaaatttctagatctatcagacaacgaaatatttaaaggcttacattataaaggaaaaccaaaaacggcaaaaaaaagagaagcaactttgttcgatccaaatgaaccaacagaattagaattcgacaaagttgaagcagaaaaaaaagcatggattagtttgcgaggagcagcgaaattacgagaagcattgggaaacgaattttatggtcgtttcgtcgcactggggaaacacgctgatgaagcaacaaaaatactaacttattataaagatgaaggacaaaaacgaagagaattaacgaaattaccgctagaggcagaaatggtagaaaggctagtgaaaatcggatttagtgactttttaaaattatcactaaaagcaatacgagatatactacccgctatggagtccggagcaagatatgacgaagccgtattaatgttaggcgtaccacataaagaaaaaagtgcaatattaccaccactcaacaaaaccgacatagacatattaaatccaaccgtaataagagctttcgcacaatttagaaaagtagctaacgctctagtacgaaaatacggagcatttgatagggtacacttcgaactggcaagggaaatcaatacaaagggtgagatcgaagacataaaagaaagccaaaggaagaacgaaaaagaaagaaaagaagccgcggactggatagccgaaacttcatttcaagtaccattaacaagaaaaaatattctaaaaaaacgattatatatacaacaagatggaagatgtgcatatactggagacgtaattgaactagaacgtctatttgatgaaggctattgtgaaatagatcacatattaccaagaagcagatctgcagatgacagttttgccaacaaagtcttatgtctggcacgcgcaaaccaacaaaaaacagatcgaacaccatatgaatggtttggacatgacgccgcaagatggaacgctttcgaaactagaacaagcgccccatcaaatcgggtaagaacagggaaaggaaaaatagacagactattaaaaaaaaatttcgatgaaaatagcgagatggcgtttaaagataggaatttaaatgacacaagatatatggctagggcaataaaaacatactgcgaacaatattgggttttcaaaaacagccacaccaaagcaccagtgcaagttagatctggaaaactaactagcgtgctacggtatcaatggggtctggaaagcaaagatagagaatcccacacacatcacgcagtagacgcgataattatagcttttagcacacaaggaatggtacaaaaactctcggagtattaccgctttaaagaaacacacagagaaaaagaacgtccaaaattagccgtaccattggccaattttcgagacgcagttgaagaggctactagaatagaaaacacagaaaccgtcaaagaaggtgtcgaagttaaaagactactaataagccgaccacccagagccagggtaaccggacaagcacacgagcaaacagctaaaccatacccgagaataaaacaggtaaaaaataaaaaaaaatggagactcgcaccaattgacgaggaaaagttcgagtcctttaaagcagacagggtagcaagtgcaaaccaaaagaacttctatgaaacatcaactattccgagagtagatgtctaccacaaaaaaggtaaatttcacttagtgccaatatatttacatgaaatggtactcaatgaattgccaaacttatctctaggaacaaaccccgaagcgatggacgagaatttctttaaatttagtatttttaaagatgatctaataagcattcagacacaaggtactccgaaaaaaccagccaaaattataatgggatatttcaagaatatgcacggagctaacatggttctctcaagtattaataactcaccgtgtgaaggattcacatgtacacctgtatcaatggacaaaaaacacaaggataaatgtaaattatgtccggaagagaacagaatagctggcaggtgtcttcaaggttttttagactactggagtcaggaaggattaagaccaccccgtaaagagtttgagtgcgatcaaggagtaaaatttgcattggatgtcaagaaatatcagatagatcccttagggtactattacgaggtaaaacaagagaaacgactcggaacgatcccgcaaatgagatcagcgaaaaaattagtcaaaaaatga

SEQ ID NO: 4978 - RNA, 3180 nt, synthetic construct
  misc_feature 1..3180: note = Cas9 variant
  source 1..3180: mol_type = other RNA
atgtccaaaagactaagatatagattggctttagatttagggactaattcaataggattctgtcttttggatttaaatggtgacggaagaccatgtggcgtcagacgaatgggcgtgcgaatttttccagattttagtaaactacaacaatctttagccgcagatagacgattagcaagatcgatgagaagaagaagggatcgttatttaaggagacgcaaagctctaatgaatgctttagttgcggctgcattgatgccagcagatccaaaagcaagaaaagcattggaagcgcttgatccatatgaactcagagcggcggcggtggcaggaccactacctgcccatcagttgggtagagcgctatttcatttgaaccaaagaaggggatttaaaagcaacagaaaagcagctggtgacgagaatgaggcaggtaaagtgaaatcaggaattagtgctctaaaagcagaactagctgcaagcggggctggaacactaggacagtggcttgcagctagacatgcaaacagacaaccagtacgagcaagattaacgggaacaggtgcaaaagcaacgtatagtttctatccagaacgtgcattagtgcatgaagaatttcaagctattagagctgctcaagctccacaccacccgggggtaacagcagaacaatgggatagaatagaatcagtgatattccaccagcgaccactcaaacctgtaaaaccaggaaaatgtaccttatatcctgaagaagaaagggcgccatgggctctgcccatcgcacaaagatttcgtatattacacgaactccacaatttaaggatagtaaggcccggacaaggtgaagagggattaagtccagcagattttgatagattctttgatagattatgtagaaagggagatctaacattcaaaacattggccaaagaattaaaattaccaccagatgctagaataaacttggaagatgataaacgtgacagattgaaaggagatgctactgcagacgctttgagtgcagaaaaaggcaaaagaagaagaataggagcagcttggcatagttttccagcggacaggcaaagagaaattgtaggtagattaatagacgcagaagacgaaggcgaattagctgcttggctagtcgaggaactgggcctaccatgggaagtagcaatactaactgcagaacgacccggcttacctgacggttattgccgattatcagaaaaagcattggaacaggtcgtaccgttaatgcacgaagaacacctaccatatgatgaagcagtacgagcactcggtttacatcatagtgatcatagaaccggagaatttctagatgaacttccgtactatggccttccattagagagatttatagcgtttggaaccggggaagctgatgatccgccagaattaagaataggaagattccctaaccctaccgtacatgtagcactaaacgaactacgtagggtagtaaacagaataattagaagatgggggaaaccagaggaaattgtggtagaacttgcaagggatttaaaacaaagtcgcgcagacagagataaaacacaacgagaacaagcggataatcagaaaaagaattggacacgtacacaacaattaagggaattaggaatggaaccgacaggtgaagctctattaaggttaagactatgggaagaattaccacgaatagggtcagctcatgtttgtgtgtatacgggacaaccgataagcatgacgcaactactgcaaggagatgttgacgtcgatcatatattaccattcagcagaacattagcaaatggggcagataataaaatagtatgtcatcgacgtgcaaacagaataaaacgtaatcgaacaccctgggaagcatttggtgtagtttcggctgacggatacgattgggctgctatcgctgaaagagctgaatcattgccgaaaaacaaaaggtggcggtttttgccaaatgcaatggaaagatttgaaactgaacgaggttttatagaccgccaattggtcgagacaaggcatttaagtagagttgcaagggaatatctggggtgtatagttccactagaaaaagttagagcagctcccggccgtttaacagcaatgttaaggggaagatggggcttaaatagtatattaagtgatgcaaatctaaagaatagatcagaccatcgacaccatgcagtagatgcagcagtattaggtgtgatagatcaaagattagtacaaagagtagcggatgccgccaaaagagctgaagagaaagaattggaaaagctatttgatggactaccagatcctttcgaaggactcccaggtccttcatttagagaccaagttcaagaaagggcacagggtattattgtaagtcataaaccagaacacgggtggcagggaagaatgcataatgatacagcatatggtccagtagagcgattgcccgacggaacacatagagtggtgacacgaaagccattagggtcactggcagagaaagattttggaaacataagggatagagcactagcagcagcacttgagagacatgtcgcagaacaagcggcccaaggaagatcattgggagaggctttgagctgcttcacttggacaggaggcgaagttagacgtgtcagaatgctagacaaactagggtcgcctgttgctgtacaagatgatgacggtcatacattcaaactatataaaggagacagtaacgcttggtacgaaattctaagagatggaagaggaaggtggacaggacgtatagtgtcaacatacgaagcatatcgattacatgcagaatggctcgcagaaagaggagacgggggtagatcggatgcagcattcccagattgggccgcgcgacgattatgtgcgggaataggaaaaccattattcagactatttaagggcgacatgcttgcattcggcacagcaccgaatagagaaatcatgaaggtagttaaatttagtgaaggaagaatagtattcgccggccatagagaagcgggaaacttaaaagaaagagatgctgataaagatgatccttttaaatataggacgtgttcacctgaagcattacgaaaggcacaagcacgtcccgtgggtgtagatccagccggatttgtacatgaccgaggccctttagaatga

SEQ ID NO: 4979 - RNA, 3180 nt, synthetic construct
  misc_feature 1..3180: note = Cas9 variant
  source 1..3180: mol_type = other RNA
atgggtattagatttgcttttgacctgggtacgaactctatcggatgggcagtatggcgaacagggccaggcgtctttggtgaagataccgctgcgagcttagatggaagtggagtactgatatttaaagatggaagaaatcctaaagatggacagtctctggcgacaatgagaagagttccaagacaaagcagaaaacgtagagacagatttgttcttagaagacgggatcttttggcagcgttacgaaaagcaggactatttcctgtagatgtcgaagaaggtagaagactagcggcgactgatccataccacttaagggcgaaagcattagatgagagtctgacaccacacgaaatgggaagagtaatatttcatctaaatcaaagaagaggatttcgtagcaacagaaaagcagatcggcaagatagggaaaaaggtaaaattgccgaagggtctaaacgattagcagagacactagctgcaaccaactgtagaactttaggggaatttttatggtcaagacacaggggaacacctaggactcgatctccgactagaattaggatggaaggagaaggtgcaaaagcactatatgccttttacccaacacgagaaatggtaagggcagagtttgaaagactatggacagctcaatcaagatttgcgcctgatctactaacaccggaacgacatgaggaaatagcgggtattttgtttagacaaagagatctagctcctcctaaaattggatgttgtacattcgaaccttctgaaaggagattacctcgcgcactgcctagtgttgaggcaagaggaatttatgaaagattagcacatttacgaattacaactgggccagtctcggaccgtggattaacaagacctgaaagagatgttcttgcatctgctctattagctggcaaaagtcttactttcaaagcagtgagaaaaactttgaaaatcttaccacatgctctagtgaattttgaggaggcgggagaaaaaggcctagacggtgcattaacagcaaagttgttaagtaaacctgatcattacggagcagcctggcatggtttatcttttgctgaaaaggatacattcgttggaaaactcctggatgaagctgatgaagaaagactaattagaagattagtaacagagaataggctaagcgaagatgcagccagaagatgcgcttctatccctctagcggatggttatggacgtttaggtaggacagcaaatactgaaatattagccgcattggtagaagaaacggatgagacaggcacggtagtaacatatgcagaagcagtacggagagctggagaaagaacaggacgaaactggcatcatagtgatgaaagggacggtgttattttagatcgacttccatattatggggaaatcctacaaagacatgttgttccaggcagcggagaaccagaagagaaaaacgaagcagcacggtggggtagacttgcaaatcccacagttcacattggattgaatcaacttagaaaagttgtaaaccgactaatagcagcgcacggaagaccagaccaaatagtcgtagaactagctcgtgaactaaaattaaatagagaacaaaaggaaaggctagatagggaaaatagaaagaatagggaagaaaatgaaaggagaacagcaatactggcagaacatggacaaagggatacagctgaaaacaaaataagactaaggttatttgaggaacaagcaagagcgaatgctggaattgcattatgtccatataccggcagagctataggtatagctgaactatttacatcagaagttgaaatagaccatatcctaccggtaagtctaacgttagacgacagcctggcgaacagagtattatgcaggagagaagcgaatcgagagaaaagacggcaaacaccatttcaggcctttggtgcaaccccagcgtggaatgatatagttgctagagcagctaaactcccacctaataaaagatggcgatttgatccagcagcattagaaagatttgaaagagaaggtgggtttttaggaagacaactaaatgaaacaaaatatctttcacgcctggctaaaatatacctgggaaaaatatgtgatccagaccgtgtatacgtaacacctggcacattaactggattgttgagagcaaggtggggattaaatagcatattatccgattctaatttcaaaaatcgaagcgatcaccgtcaccatgcagttgatgcagtagttattggggtactaacaagagggatgatacaaagaatagcacatgacgcagcaagagcagaagatcaggatttagatagagtattcagagatgtcccagtgccattcgaagactttagagaccatgtaagggaacgagtaagcacaataacggtagcagttaaacccgagcacggtaaaggaggggcactacatgaagatacgtcatatggactggtaccagacacagacccgaacgctgcgttgggaaatttagttgttagaaaaccaattcgtagtttaacagctggtgaagtagatcgagttagagatagagcactaagagcaagactaggagctttagccgcaccatttagagatgagagcggaagagtaagagacgcaaagggactcgcacaggcattagaggctttcggagcggaaaatggtatacgaagggttagaatcctgaaaccagatgcgtcagtagtaacaatagcagatagaaggacgggggtaccataccgagctgtagcacccggcgaaaatcatcacgtagatatcgtacaaatgcgggatggaagttggaggggctttgcagcatccgtttttgaagttaatcgaccaggatggagaccagaatgggaagtaaagaaattgggtggaaaacttgttatgagactacataaaggagacatggtagaactatcagataaagatggtcaaagaagagtgaaagtagtacaacagatagagatttcagccaatagggtaaggctttcaccgcataacgatggtggaaaacttcaagacaggcatgcagatgcagatgacccatttagatgggatttggcgactataccattattaaaagaccgtgggtgtgtagcggtaagagtagatcccataggagtcgttacactgagaaggagtaatgtttga

SEQ ID NO: 4980 - RNA, 3183 nt, synthetic construct
  misc_feature 1..3183: note = Cas9 variant
  source 1..3183: mol_type = other RNA
atggcagtaaaatccctaaattatatactaggtctcgatttaggaatagcaagctgtggatgggcagtcgtagaaatggatgaacaagagaatcctttaagattaatagacgtaggcgtacgtacttttgaagaagcagagaatccaaaagacggatctagccttgctgaaacacgacgactcgcacgagcccaacggcgattgatctcacgaagagcaaatcgcatgaacaaacttagaagactattaaagcaagaaaacgtgctccaggcaaatgactacgacgagaaaggattaataataggattaccgaatcaagcatgggaattacgagcacaaggattagataggaaacttgagccaaaagagtgggccgctgtattaatacatttggtaaaacacagaggctacctaagccaaagaaaaaacgaatctcaaacagcagataaagaacttggagcactactatctgggatgaatcataatcatcaactattacaaagtcaatcaaatcaatatagaacacctgcagaattagcaataaaacaatttgcaacacaagacggtcatataagaaatcaacgcggagcttatacccacacttttaacaggctcgatctccaaaatgaactcaaccaattattcgatgcccaaactagacttgggaacccacatgtcagcggatcattaaaaacagcaatcaacgatttattaatgaatcagaaagcagcactatctggcgatgcgattctagaaatgttaggaagatgtacattcgagccaagtgaatataaagcagccaaaaacacttacagtgccgaacgatttgtctggctaggaaaattaacaaacttaagaatccaagacaacggcctggagtcagctctaagtagagaacaacgagaattattgctaaatgaaccttacaacaaaacaaaactgacttatcaacaagtacgaaaactactacgactaccagaaactgcatttttcaaaggacttagatacggtaaagacaatgcagaaagtgcaacactaatggaaatgaaatcatatcacgcaatacgtaaatcactcgaaaataagagtttaaaatctgaatgggagaaattgaaaactcaaccaaaattgttggacctaataggaacggcttttagtatctacaaaacagacgacgagattgcaggctgcttaaaaaaccaattaccagaaaacgtaatcatagccttacaagaacaactaaatttttcgaatttcatggaattgtcactcaaagcacttgagaaactactacctcttatggaacaaggattaagatacgatgaagcctgcacacaaatatatggaaatagacatgaaaaaatagcggacaaaacagaaaaattcctaccaaacatacccgcagacaaactcagaaaccctgttgtactacgaacactaacgcaagcccgaaaagtaataaatgctataattagaaggtacggatctccagctcgagtacacatagaaacaggaagagaagtaggaaaatcatttagcgaccgtgataaattaaaaaaacaacaggaagaaaatcaagaacaacgacgaagagcaatcgacgaatggaaacaatttttcccgaacgctgcgcacgagccaaaggcagttgatattttaaaactacgcctctatcaactacaacaaggcaaatgtctatacagtggcttaccaatcgatgttagacgattaccagaaaaaggttatgtcgaaatcgaccatgccctaccattcagcagaacatgggacgactcatttaataacaaaattcttgtactagcttccgagaaccagaataaaggaaaccaaacaccgtacgaatacttacgcggtgccgataattcagaatcttggagactattcgtagaaaatgtacaaaactgtcagttttcacccaataaaaagcaaaaaattatggcaaaacaattagatgaaaaaggatttcttgaaagaaacctaaacgacacacgatatgtctcaagatttttatgccagtttatcagtgaatatctacacctgaccggaaaaggaaaaaaaagagtgtttgcaagcaatggacaaatcacagcattacttcgtggacgatggggacttagtaaaaacagagaagaaaatgatagacaccacgcagttgacgccgtagtagtagcatgctcaactgtagcaatgcaacaaaaaataactcaattcgtcagatatcaaaaaggaaacgtctttacgggcgaaagaatagataaagaaactggcgaagttatatcaattcatttccctacgccttgggagcactttagagaagaagttatgatacgagtattcgatgataaccctttaagaacactaccagaaaaactcccaaataggcctgaagccctacacgaatatgtaatgccactattcgtaagccgaatgcccacaaggaagatgacaggacaagggcataaagaaaccataaaaagcgcaaaaagactagacgaaaaaataagcgtactacgcgttccattgacacaattgaaattgaacgatttagaaaacatggtaaaccgcgagcgcgaaccagccttgtatgaagccctaaaagcaagattagaacaatttaaaaatgacccagcaaaagcgttcgcagaaccatttttcaaacaaggcggtcaacaggttaaggcagtaagagttgaaatagttcaaaagagcggtatgttactaagaaaaataaatggtgtagccgataatggcagtatggtaagagtagacgtatttgaaaaatcaggaaagttctacctcgtgccaatttacgcatggcaagttgcagaaggaattttaccaaaccatgcagtagtacacagtaaagatgaatccgactggattttaatggatgaatcatatcatttcaaattcgcattgtacaaaaatgacctactggaagttcaaaccaaaaaaggatgtatcatgggatatttcgcaagtctagaccgcgcaacaggtgcaataacaatcagagaacacgacagagacaaaaaaaaatgcaaagacggagaacacaggtcaataggagtcaaaatggcatcctcctttaaaaagttacaagtggatgaattaggtaaaaacattcacgaaacaagaagcagaaaacgacctaatattggctga

SEQ ID NO: 4981 - RNA, 3186 nt, synthetic construct
  misc_feature 1..3186: note = Cas9 variant
  source 1..3186: mol_type = other RNA
atgcataccctaccatatactctaggactagacataggaattgcgtcagtaggtgccgcgctattaagtgatgaatccatacttggaatgcacgtaagaaccttttccgcagcagaaacagataaagaaggagatccattaaataaaatcagaagagaagcaaggagtgcccgtaggagaatacgtaggagagcacacagactacttcgacttagacgacttcttaaacgtaccggactaatcagcgatacgagtttagaagtactaaaaacatctaaaacaccatggcaactaagaagtgaaggacttgatcgactactatcccccagtgaactagctgctgcactctatcatatagtaaaacatcgaggatttcaatccaatcgaaaagcagaattaaaaacggacgcaaaggcgggacagatgctaagtggcgtatcagcaaaccaacaattaatgagagataaatcatatagaacaatagccgagatggtatgtaaagacgacgcattcaaagaccataaaagaaacaaagggggttcctatcgaaacacatttgctagatcagacctagccgacgagctaaaaacactactaaagaaacaaagagaatacgacaatccccttgcaacccctgagctagaagaagcagttcatacacttttaatggcaagaagaccagtctttaaagacgacgatatagaaaaactcgttggattctgtacctttgaacatggagagaaaagagcgccgaaagcagcattctctagcgaaaggtttatatggcttggaaaattaaataacttaagattaatttatccaggagaacagaggtcattaactccagaagaaaggtcccaaataattaatttaccatttacacaggcttcagttaaatttagtcaaatcagaaagaaattagatctacctgaatatgttagattcaacttagtgcgttataaaccaggtgaagaaaccagcaaaagcgaaacggcaacctttttcgaagcaaaggcattccacgagctaaggaaaacttatcgggagtccggtataagtgaactttgggaaagagatcaacatgacccacaacgactagatcaaatagcaacagcaatagcagtatatagagacgatgaacgaattagaaacgaattatcacctcatactatagaaaacgaagtggtagaagccgtactaaattgtgattttactcaattcataaatttaagcctaaaagcgttaaataaaatactaccatatatggaacaaggccaaagatatgatgaagcatgtacatccgccggataccagcatcatagcccacaacaaaacgaagagaaaagcggccgaataccccctcctgataaaaatgtcataagaaacccagtagtatacagatctctaaaccaagcaaggaaattaataaacgcaataacaaaaagatatggagcaccagcagccattcatcttgaaatggcgagagacttatccaaaccattctctgaaagaaaaagtatagaacgagaacaagaaaaatacagaaaacaaaaagtacaactaagaaacgagtacatagaacactttggtacagaaccaaatggattaaacttattgaaatttagactctacaaagaacaagacgcacaatgcgcttacacacaaaaagcattagatctatcaagactaaacgaagcaggatacgtagaagtagaccacatcctaccatacagccgatcatacgatgattccctcttaaacaaaacacttgttttaacggaagccaatagagacaaaggaaaccgaacaccatttgaatttatgggaggagacgatcaaagtcaacactggcaaaaatttgtacggtgggtacaaatgaacccaaaaattcgtcaagcaaaaagaaatagatatttaagaaaagatttttcagaaaaagcagctagagaatttagggatcgacacttaaatgatacacgatacatcggaagagaattaaaagctatgatcgaaagccatgtacaatggcatccggactcaaaaagtaaagactgttgtgtagtattatcaggacaactaacagcattattacgaggacggtggggttttaataaagacagagcagcgggcgatctacatcatgccgtagatgccgctgttgttgctgcagcaactaggggtatgattcaaagaatggcaagacactcaaaatttcacgaactaaagaatgtaaggaccagctacgctgatccggacactggagaggtagtaaatttagctgcggctcgagatttagaaaaacactttccattaccttgggacaattttagaaatgatacacttgcttatctaaaccccagcgcaatatcagctgatgaatccgcacaagaagggcatagaggtgtccgagtttcacgggccccaaccagaaggaagttaggagccgcacatcaagaaacaattagatcaaaaggcaaagacaacattctcctagaacagggattatcagcagtaaaaacacctttatcaaaattaactttgaaaaacatagaaaacatggttggatacgaagatcccagaaacgcagcattagtcaaagttctaagagaaagattagaagccttcggtggcgatggcgcaaaagccttcgcccctaatcaaccaccagtatataaaccaagcaaaccaggtaaacaagcaccagaaataagatcggtaaaaatggcatcaaaatctaaaggggcattacacgttagggaaggtttagcagactcaggaagaatgatacgaatagacatatatgaaaccaaaaatggctacgtaggcgtaccaatatacgtcagtgataaagccagaagtaaattaccaaaagcataccccaaaaagggggaagatagagcaaattggccagaggtggatacaaacgacaacttcttattctcattatatagcacagattggatcgaagctaaaacaaagaaagaaacaatagccggatatgttaaatcgtatgacatattcgatggaagactattagtatatgctcatgataacaagaaggtggtaaggaaacttacacttagcgcattagcagacctacaaaaattacatgtttcaatattaggagacctctataagggaggaaccccgaagtgttcaccacttagaaaaggtcaagagttgtga

SEQ ID NO: 4982 - RNA, 3186 nt, synthetic construct
  misc_feature 1..3186: note = Cas9 variant
  source 1..3186: mol_type = other RNA
atgcttagattaggtttagatataggcagtactagcatagggtggtttttatacagaattacaaacggcatgatagctgaaattattgattgtggtgttagattattcagtgatggaagagacgcaaaaactggggttagttcagccgtagaacgacgaaacgctagagcgctaagaagaagaagagacagatacttacgtcgtagagctgcattaatgagaagattagctgcagcaggcctcatgccagaagatccatcacaggcaaaaccgctcgaactattagacccctatagactaagagccgatgccttggacagaagattagaacttacagaactaggcagagcactttttcacctaaatcaaaggagaggatttaaatcaaacaggcaaacagacagagggaataacgaaggaggcaaaatcatagacggaagtgcaagactagatcaagctatgatggctgtcggagctcgcacttatggggaatttttgcatctacgccgtagtcaagcagaagatttacgacgtgtcccatcagtaagaacacgactgacactaagatcagtggatgggggaaaagctgaaacagggtacgacttctatcctgataggagacacctagaagaagaatttaataaagtatgggcagcacaagctgcacatcacccagtcttaacagactccctaagacatgaagtatttgaaactatattctttcaacgaccactgaaagcgccagcagtcggtaggtgcctatttttcccagaaccccgactaccacgtgctcatcccttaacgcagagaagagtactatatgaaacagtaaacgcattacggattagaaccgaaagcggtgctgcggtaccactgggtaaagagcaaagagacaaagtaataatgctattagacggaaaagcacccgtaaaagccatcgcttcagctaaattatctctaaaagcaattgctaaacacctgaaattaagggatggccagacatttacattagaaaaaggaagggattatatagcgtgtgatccagtaagggcatctttgagccatccggatagatttggtcccagatggtctgttttagaagcggaagtacaagctgaaatagtaggaaggattagagatgacgatgataccatggcattagtagaatggttaaaacaagttcatggtttagatgatgcacatgcaagagccaccgcggatgcaccacttccagaaggctacggaagattaggagagaccgcgacaagaaaattattagactgcttaaaagcagaagtacttacttactcggaggcagtaggtaaagcgttagatcaacatcatagtgatagaagaacaggggaaatcctagaatctctaccatattacggtgaagtattgcaagctcacgtaatcccaggaactggagaaccacaccacgatgatatcacaaggttcggaaggataacaaatcctacggttcatattgggctaaatcaactcagaaggcttgtgaataggattatcgcacgatacgggaaaccagcagaaattgtagtggaattagctagagatttgaaacaaagcacaggtcaaaagaaagcggcaatagcattgaatttgaaaaacaggaaagcagcagaggctagaagtgcgttgttgactgaatggggagttccagatacaggggctaatagaatgtacgtacgactctggcaagaattacatgaagaccccatgatgagacgatgtccgtatacaggaacaatcatatcacccagccttttattttctggtgctatagacattgaccatatacttccctactcaagaactttagatgattccacagcaaatcgaacattgtgtatgaaagaagcaaaccgacagaaaagaaacaaatcaccatcagaagcaagaagagacggtatgagaatttgggcactagaagatgataatttaagacatataccggaatttaaaagatggagatttgcagaagatgctatggcacggttcgaaggtgaaagggactttgaagcgagagctctagttgatacacaatacctttcaagaatatctaaagcatatctagaaacattatatgatggagcagatggtaaatctcacgtgtgggtggtacccggaaggttaactgagatgttgagaagacattggggtcttaatggaatactaacagatcctcttcgtgacgtgacaaaagagaaaaatcgaatggaccatcgtcaccatgcaatagacgcagccgttgtagctgcaacagaccgaggactgattaaagcaatggcagaacaagcaagaacagatgttgaccaaggaagagaagctctagcttcaagtataatgccaccttggccggggtttagagaagcagtagcggcacaagtcgacaggataatagtcagccataggccagatcatggcagaatagatttaactacgagaatgaaaggtagagatcagactacaggaccactacacagggacactgcatatggactaacaggacaatccgaaaaaggagtccctcttgttgtaacgagagaaccttttgataatctaactccaacaatgattggaaaaatacgagacgaaccgctaaaagcagcactagctgccgttacagctggaaagaaagatgacgcatttgcggaagcattggcccactttagagaccgaccaggaccataccatggcataagaagagtaagattgattgaaccaatatcagtcgtagaaataagagacgcaagtggacgcgcatataaaggttataaaggaaacagcaaccattgttttgaagtatggagactaccaggcggtgcaattacagaacatatagtttcgacgtttgatgcacaccaacccggtcctgaacctcgacctcatccagctgcaaaaagattattaaggttattcaaaagtgatatggttaaattagacgacagcaaattcggaccagtaatagcgactgtagtcatgttcgatcggaacggtaaaatatccttagtgccacataccgcaagtaatgctaggaaaagatgtgaaaaatataaagaagatttatatttacgattcacagctagaactttaatagaagctggggctagaagaataatagtcgatgaaaccggacatttccgagacccaggaagaaaaggatga

SEQ ID NO: 4983 - RNA, 3189 nt, synthetic construct
  misc_feature 1..3189: note = Cas9 variant
  source 1..3189: mol_type = other RNA
atggccgaaaaacaacatagatggggattggatattggaacaaacagcataggttgggctgtcatcgcactcatcgaggggaggccagcgggtctcgttgcgacaggatcacgaatattctcagacggaagaaatcccaaagatggatcatcactagcagtagaaagaagaggcccacgacaaatgaggcgcaggcgagatagatatcttagaagaagagatcgatttatgcaagcgttaatcaatgtcggattaatgcctggagatgccgcagcaagaaaagcattagtaacagaaaacccatacgttctaaggcaaagaggtttagaccaagcacttactttaccagaatttggcagagcattattccatttaaatcaaagaagagggtttcaaagtaataggaaaacggatagggctacagcaaaagaatcaggaaaagtgaaaaatgccattgcagcattcagagcaggtatgggtaatgcccgtacagtaggagaagccctagcaagacgattagaagatggaaggcccgtaagagcgcggatggttggacagggaaaagatgaacactatgaattatatattgcacgtgaatggattgctcaggagttcgacgcattatgggcatcacagcagagatttcatgctgaagtcctcgcagacgccgctagagaccgtttgagagcaatcttattgtttcaaaggaaattgttacccgtccctgtgggaaaatgttttctagaacctaaccagccaagagtagcagcagcattaccatcagcacaaaggttcagacttatgcaggaactaaaccacctacgagtaatgacattggcagataaacgagaaagaccattatcattccaagaaagaaatgatctattggcacaactcgtagcaagacccaaatgtggatttgacatgctaagaaaaatcgttttcggtgcaaataaggaagcatatagatttacgatagaatcagaaagaagaaaagaacttaaaggatgtgatactgctgcaaaattagccaaagtgaatgcactagggacgagatggcaggcgctatcattagatgaacaagacagacttgtatgcttactattggacggggaaaatgatgcagtattagccgatgctttaagggaacattatggcttaacagatgctcaaattgacacactactaggacttagttttgaagatggtcatatgaggcttgggagatcagcactgttaagagtactagatgcattagaatcaggccgtgatgaacaaggattaccactgagttatgataaagctgtcgtggcagcagggtatcctgcacacacagcagatttagaaaacggagaaagagacgcattgccgtattatggcgagttattatggcgatatacgcaagatgcgccaactgctaaaaatgatgcagaaagaaaattcggaaagatcgcaaaccctactgtacacataggattaaaccagctaagaaaattagtgaatgccttaattcaaagatacggaaagcccgcacagatagtagttgaacttgcacgaaatttaaaagccggtttagaagaaaaagaacgaattaaaaagcaacaaactgcaaatttggaaaggaatgaacgaatacgccagaaattacaagatgctggtgtcccagacaatcgagaaaatcgtctaaggatgcgtttatttgaagaattaggtcaaggaaatggactaggaactccatgtatatatagtggaagacaaataagtttacaaaggttattctcaaatgatgtacaagttgaccacatattaccttttagcaaaacattggacgattctttcgcaaataaggtattagcacaacacgatgcaaacagatataaaggtaacaggggtccctttgaagcctttggtgccaatcgcgatggctatgcttgggatgatatacgcgccagagcagccgttcttccaagaaataaacggaatcgttttgccgaaacagccatgcaagattggttacataatgaaacagatttcttggcacgtcagttgacagacacagcatatcttagcagggtggcaaggcaatatttaacggcaatatgtagcaaagatgatgtatacgtgagcccaggtagattaacagcaatgttgagagctaaatggggattaaatagagtactagatggagtaatggaagaacagggcagacctgctgttaaaaaccgggacgatcatcgacatcatgccatagacgcagtagttataggagcaacagacagagcaatgctacaacaagtcgccacgctagcagcacgggcaagagaacaagatgcagaaagacttattggagatatgcctacaccctggccgaactttttagaagatgtccgagccgcagtagcacgatgtgtagtaagtcataaaccagatcatggaccagaaggaggattacataatgacacagcttatggaatagtagcaggaccttttgaggatggaaggtatagagttagacatagagtatcattgtttgatcttaaacctggagatctcagtaatgtacgttgtgacgcacctttacaagccgagttggaaccaatatttgaacaagacgacgcaagagcacgtgaagtcgcgttaacagcacttgcagaacgatataggcaaagaaaagtatggcttgaagaattaatgagtgtacttcccattaggccacgaggagaagatggtaagacactaccagatagcgcaccttataaagcgtataaaggagatagtaattactgttatgaacttttcataaatgaaagaggccgatgggacggcgaattaatttcaacatttagggcaaatcaagctgcatacagaaggtttagaaatgatcctgcaaggtttcgaagatacactgctggtggcagaccgttacttatgagactatgcataaatgactatattgcagtggggacggccgccgaaaggacaattttccgagtagtaaaaatgagcgaaaacaaaatcacattggctgaacattttgaaggaggaacgttaaaacaaagagacgcagataaggacgatccttttaaatatctaacgaaaagtccaggggcgttaagagacctaggagcgcgaaggatattcgtagacttaataggtcgcgttctagatccaggtataaaaggcgattga

SEQ ID NO: 4984 - RNA, 3189 nt, synthetic construct
  misc_feature 1..3189: note = Cas9 variant
  source 1..3189: mol_type = other RNA
atgaatttaaattatatactaggtctagatcttggaattgcctcagttggatgggcagtagtagaaatagatgaacaagaaaacccacaaagactaatagatgtaggtgttagaacttttgacagagccgaagtcctaaaaacaggcgaatctttagctcttgctcgaagactagcaagaagcagcagaagacttgtaaaaagaagggcagaaagaattaaaaaggctaagagattactaaaagctgaaaatcttctactatcggcagatgaaatacttcctaacgaggcttggcaattacgcgtaaaaggcttagatcaaaaattagaaagacaagaatgggcagcagtgttactacatctacttaaacacaggggttatctaagtcagcgtaaaaacgaatcaaaaagcgaaaataaagagttaggtgcattgctcagcggagtcgcgataaatcaccaaatattacaaagtgcagaatatagaactccggccgagatagcagtaaacaaattccaagcagaagagggacatataagaaatcaaagaggggcgtatacacacacattttcaagactggaccttttggccgaaatggaactattattccaaagacaagcaaccctaggaaatccacatacttcgactaaattactagaaaacctaaccgcattactaatgtggcaaaaaccagcattagccggtgaagcaatattaaaaatgttgggaaaatgcacgttcgaaccaactgagtacaaagccgcgaagaatagttatagtgcagaaagattcgtttggctgaccaaactaaacaatttaagaatattagaacaaggcgcggaacgcgcacttactgacaatgaaagatttgcattacttgaccaaccatatgaaaaagcaaaactaacatatgcccaagtacgaactctcttaggattaagcgatgaagcgatcttcaagggcttaagataccaaggagaagacaagaaagcggtagagacaaaaactacattaatggaggtaaaagcataccaccagataagaaaagcactagaaggtttagatttaaaagctgaatggaatgaattgaaaaataatccggcgttactagatgaaataggaacagctttctcattatataaaacagacgatgacatccacagatatttagacggaaaattatctgaaagcgtgcttaatgctctcttagaaaatttaaattttgacaaattcatacaactatccctaaaagcactacaacaaattttacctttaatgttacaaggtcaacgatacgacgaagcagtatcagcaatatatggagaccactatggaaagaaatcggacgaaattgacagattactcccaaatatcccaactgacgaaatacgaaatccagtagtattacgaacactaacacaagcaagaaaagtaataaacgcagttgtaagactatacgggagtccagcgaggattcatatagaaacaggaagagaagtaggaaaaagctatcaagatagaaagaaacttgaaaaacagcaagaagaaaaccgaaaacaaagagaaaatgctgtgaagaaattcaaagaatactttccaaattttgtaggggagccaaaaggaaaagatattttaaaaatgagactatacgaattacaacaagccaaatgtttatactcaggaaaaagtctggaactatatcgcttacttgaaaaaggatatgttgaagtcgatcatgctctaccatttagtagaacttgggatgattcatttaataataaagtgctagtattagctaacgaaaatcaaaataaaggaaatgcaacaccctatgaatggctcgacgggaaaaataattcagaaggatggcaacatttcgtagcaagagtccaaactagcggtttctcctatgctaagaaacaacgcgtacttatacaagaactagatgaaaagtcatttatagaaagaaatctcaatgatacgcgatatgtagcaaggtttctatgtaatcatatagcagacaatatgcttctaaccggtaaaggaaaacgtaaggtctttgcttcaaacggacagataactgcacttttacgaggatgctggggtttacagaaagtccgagaaaataacgaccgacatcatgccctagatgcggtagtagtagcttgctcaacaaaatcgatgcaagacaagataacgaagttcgtaaaatataaagaagggagactttttaaagataagaaagacggagtttataaaggtgaaaggataaatagagaaacaggtgaaataataagcctacactttcccaccccatggaaatttttcaaagaaaatgtagaaattcgcatattctcagaaaacccgaaactagaactcgaaaataggctaccagactatccacaatataaccatgaatttgtacaaccactatttgtatcaaggatgccgactcgaaagatgacaggacaaggacacatggaaactgtcaaatcagccaaacgacttgataaaggtctaagcgtactgaaggtaccgttaacacagttaaaactatctgacctagaaagaatggtaaacagagaacgtgaaatggcactgtatgaagctctaaaagaatgtttagaacaatttggaaacgatccagctaaagcgttcgcagaaccgttctataaaaagggaggagctttagtaaaagctgtacgcgtagagcaaactcaaaaatccggagtgctagtacgcaacggcaatggcgtcgcagacaatgccacaggaagtatagtaagagttgatgttttcactaaaggagggaagtactttcttgtaccaatatacacttggcaagttgcaaaaggtatattacctaataaagcagtaatccaaggtaaagatgagtcagaatgggaagaaatggatgaaaacgcggttttccaattctcaatgcacaaaaatgaccttattaaagtaaaaacaaagaaaggagaaatatttggatattttaacggactagatagagcgacaggaagtattgaaatagaagaacacgatctagagaaatctaaaggcaaaaatggaagtcatcgtggactgggagtaaaaacagcattcttcttggaaaaatatcaagttgacgaactgggcaaaaatataagaccatgtagaccgacaaaaagacaacatgtccgatga

SEQ ID NO: 4985 - RNA, 3192 nt, synthetic construct
  misc_feature 1..3192: note = Cas9 variant
  source 1..3192: mol_type = other RNA
atggaaaatcatataaattacagactaggccttgacatagggatagcctcagtgggctggagcgttataaatctcgataagaaaagaatagaagacttaggagtaagaattttcaatgctgcggaacacccaaaagatggaagtagcttggcacttccgagaagaatcgcaagaggaaggcgaaggttgttaaggagaaaggcatacagagtaaaaagagtaaggaaattaattgtagactataatatattaacaaaagatcagctaaacgacctatttaaacaaaaatgtcaaaattccgtatgggaaataagagtcaaagcattagacaacaaagtaacaaatgaagaatgggctaggctactgataaatttatgcaaaagacgaggatttaaaagcaacagaaagaacgaagcagatgacaaagagaccaagaaagtaataaatagcataaaatctaatattaaaggaatgaaagaaagtggcagtagaacaataggagaatatatctatacacaaaccctgagcagtggcgatatctcaaaatcattcagaaataaagatggtcaatacaataattgcgtatccagaaaaatgatagaggaggaaattaaaatactatttaagaaacaaagggaactgggatgcgagttcgcttcagaagaaatagaagaaaaatatctcgcaatattcaattcacaaagaccatttagtaaattcgaagatttagagaaaatggtaggattctgtacgtttgaaaaagcgagcaaagaaaggagagccccaaaatgtagcataagcgctgaagaatttgtattatacgataacatgaacaaactatccatattaaataaaggagatacaagaaaactaactaacgaagaaagaaaaatcatcgtagaaaatgcattcaaaaacaaagaaataaaatattcaaaactacgaaagatattaaatctgtccaacgacgaaagattcagcactctttcatacagcaataaaaccgaactaagcaaaacagaaaacagcaaatttgtagcattaaaaggataccatgaaataaaatccgccattgaaaagagctttggaaaagacacatggaacagggtcaaaaataataggacaatgctcaatgatatagcgtatgttctaagcatagcaaaaaccgacgaagacataatcaaacaactaagtttaagaaacatacctagggaaataatagatgctgttttaggtctatcattttcaaaattcagcaatctatctattaaggccatcgagaaaatactaccttatctcaaagacggacagcaatataatgaagcatgcaaatcagcaggatacgacttcaaagcaacatacaatggagagaaaagctataaactccccttaatagatatagacgaaatagtaaatccagtagtgaatagagcactaagtcaaacaagaaaagttataaacgcagttatagacagatatggctcaccaataggaattaatatagaactggcaagagatttagccaagaattttaaagatcgaagtaaaatcaaaaaggaacaagaagaaaatcgcgctaacaaagagaaaatcaaaaatgaattaaaaatgttaatgaacaaagaacctacctcatcagaaatactaaagtacagactctggaaagaacaacgagaagagtgtgcatatagtcaagaaagaatatatatagaagacctcttcaaagtaggacagtacgagatagaccacatcataccatttagtaggagctttgatgattctttaaacaacaaggtcttagtaaaagccgctgaaaaccaacgaaaagcaaaccgaataccatatgaatactttggcagcgatgaagatcgatggtaccgcttcgaagtatgggttgaacagtcatcacttagcttcaaaaagaaaaataatctactcaagaaaagattttcccgagaagacagcatagaatttaaagatcgaaatttagtagacacacaatacataagcagatacatttcaaacttcataaaaagccgattaatattcaaagaaagcgactcaaaacaaaaagtaataacgataaacggacgagcaacttcatatctaagagcaaaatggggattattaaaagtaagagaaaatggcgacaaacatcacgcattagacgcaacagtcatagcggtagcaacgcaaggaatggttcaggagatatcaaaatactcgaaagcccatgagctaaaatacattagacaaggagacgagttcatagacatagaaacaggagaaatagtaaaagttaaagaccacaaacacctatcaaaagatcgtttaccagaaccatggctaggcttcagcagcgaactacgactccggctttctgaaaatccaatagaagaattaaagaaaagtccgataagcacatacgatgaagaatttatacgaaaaacagtaagaccaatatttgtaagtagagtcccctacagaaaagtcacgggaagactattcgaggaaaccgtatatagcccaaaagcctttatagacgaaggtttcatcgccaaaaagaaactacaagatttgacattaaaagattttgaaaacatctacaattacaacagtgacaagaaactatacgatgcattacgcgaaagactagaagaatatggtggaaacgcaaagaaagcgttcgcagaagagtttaggaaaccaacgaaaacaggaaaattaggacctatagtaaaatcaataaaagtaaaaacaaaaattccattcaaagatggaatagacttgaatggagggaaagtgaagaaagatggtctagtaagaatagacatatacgaaaaagagggaaaatactacgtagtgccagtgtatagattagacattcaacaaggaaatatcccaaagaaagctgcagtagctaacaaagaagaaaaagactggatacttatggatgaaagttataacttcaaatttagcctttacaaaaatgacttaatatacataaaatacgactccaaaggagaatacttcggatactatgacggattcgacagacatacaggagccataacactagaacgacacgacaactccgagagatataggggaataggaataaaaacgggcgtaaaagagatatttaaatataacgtcgacgttctaggacgatattataaagttgcaaaatga

SEQ ID NO: 4986 - RNA, 3192 nt, synthetic construct
  misc_feature 1..3192: note = Cas9 variant
  source 1..3192: mol_type = other RNA
atggaaaagtttcattatgttctcggcctagacctgggaatagcttcagtgggatgggcagctattgaaatagataaagaaacagagacatcaattggactcctagactgcggtgtcagaacatttgaacgcgcggaggttcctaagaccggggattcattagcgaaagctagaagagaggctcgaagcacaagaagactgataagacgacgtagccatagattattacgactaaaaagactactaaaaagagaaatattcagacaaccagaaacattcaaagatttaccaataaatgcgtggcaacttagagtaaaagggttagattcacgactcaatgaatacgaatgggcagctgtattactacatctcgtcaaacatagaggctacctttcacaaagaaaaagcgaaatgtcagagacagactcgaaatcagaaatgggccgacttttagcgggtgtagcagaaaaccatcaactactacaacaggaacaatatcgaactccggctgaattagctctgaagaaattcgttaaacacttcaggaataaaggtggagattatgcacatacattcaacagactagacttacaagcagaattacacctactcttccaaaaacaaagagaattaggaaacccatttacaagtcctgagctagaaagacaagtagatgatcttttaatgactcagagatcagctctacagggagatgcaattttgaaaatgctaggtcactgtggcttcgaaccagaacaattcaaagcagccaaaaatacattctctgccgaacgattcatatggctaacaaaattaaataatctacgaatacaagaccaaggaaaagaaagagcattaacagcagatgaaagaacaaaactattagatgaaccatataagaaaagcaaattaacatatgcacaagtaagaaaacttctatctctcccacaaacagctatttttaaaggattaagatatgatttagaacacgataagaaagctgagaactccactctaatggaaatgaaatcctaccataatataagacaaaccttagagaaaagcggattgaaaacagaatggcaatcaatagcaactcaacccgaaatccttgacgccataggtacagctttctcaatatataaaactgatgaagatatatcccacgagcttaaaacatgtagacttccagaaaatgtgttgaacgaactattaaagaatattaatttcgacggatttatccaactatcactaactgccttaagaaaaatattgccgctaatggaacaagggtataggtacgatgaagcatgtacgcaaatatatggcaatcatcactctggatcattacaacaggaatcaaaacaatttttaccgcacatacctatagacgatgtcagaaatccagtggtatttcggacattaacacaagcaagaaaagtcgttaatgcaatcattaggaggtatggatcgcctgcaagagtacacatagaaatggcgcgagaattaggcaaatcaaaatcggatagggatagaatcgaaaaacaacaacagaaaaataagaaagaacgagaaaatgcagtagcaaaattcaaagaagactttccggacttcgttggcgaacctcgagggaaagacattctaaaaatgagattatacgaacaacaacacggaaaatgcctctactcaggacatgacatagacataaatagactaaatgaaaaaggctatgtggaaattgaccatgcactaccttttagtagaacctgggacgactcacaaaataacaaagttttagtactcggatctgaaaatcaaaacaaaagaaatcagacacccgatgaatatctagatggagctaataattctcaaaggtggttagaatttcaagcaagagtacaaacctgtcacttctcatatggtaagaaacaaagaatacaactagccaaattagacgacgaaacggaaaaaggattcctagaaagaaatctaaatgacactcgatacattgcacgttttatgtgtcaattcgtgcaagaaaatctatatctaacaggcaaaggtaaaagattagtatttgcaagtaatgggggaatgacagcaacattaagaaatctgtggggactaagaaaagtaagagaagataatgataggcatcacgcccttgatgcaatcgtagtagcctgctctaccgcgtcaatgcaacagaaaatcacaaaagcattccaaagacatgaaagtatagaatatgtagacacagaaacaggcgaagtcaaatttagaatcccacagccatgggactttttcagacaagaagtcatgatccgtgtcttttccgatcaaccatgcgaagatcttgttgaaaaactaagtgcaagaccagaagcattacatgataacgttactccactatttgtttctagagcaccaaatagaaaaatgtccggacaaggacacctcgaaacaatcaaaagtgccaaaagattaagtgaagaaaacagtatggttaagaaacctttaactacattaaaactcaaagacatcccagaaatcgttggttatcccagtagagaaccacaactgtacgcagcattgaaaactagattggaaacacatgatgacgatcccattaaagcatttgcaaaaccattctataaaccaaacaaaaatggagaactgggagccttagtgagatcagtaagagtaaaaggagttcaaaacacaggagtaatggtacatgatggaaaaggaattgcggacaacgccacaatggtaagagtagatgtctacactaaagcagggaaaaattatctagtcccagtatacgtatggcaagttgcgcaaggcatacttcctaacagagcagttacgagtgggaaaagcgaagctgattgggacttaatagacgagtcatttgagttcaaattcagtttgtcaagaggagacctagtagaaatgatctctaacaaaggtcggatatttggttactacaatggactagatagagcaaacggtagcattggaataagagaacatgatttagaaaaatcaaaaggaaaagatggagtacaccgagtaggggtcaaaacagctacagcattcaacaaatatcacgtagaccctctaggaaaagagatacatagatgttcaagtgagccaagaccgactctaaaaatcaaatctaaaaagtga

SEQ ID NO: 4987 - RNA, 3192 nt, synthetic construct
  misc_feature 1..3192: note = Cas9 variant
  source 1..3192: mol_type = other RNA
atggaaaaagactacatacttggactagacataggcataggctcagttggttacggtctaatagattatgacacaaaaagcataatagacgctggcgtaagattatttccagaagccaacgctgataacaatctcggaaggagagcaaaaagaggcgccagaaggcttaaacgacgccgtattcacagactagaacgtgtcaagtccctactatcagaatataaaattataagcggactagccccaacaaacaaccaaccctataatataagagtaaaagggctaaccgagcaattaacaaaagacgaactagcagtcgcactcttgcacatagccaaacgacgagggattcataatgtcgacgtcgccgcagacaaagaagagacagcaagcgatagcctctcaaccaaagaccaaataaacaagaacgcaaaattcttagaatctagatacgtgtgtgaactacaaaaagaacgcttagaaaacgaaggtcacgtaagaggagtagaaaacagattcttaactaaagacatcgttagagaggcaaaaaaaattatcgacactcaaatgcagtattaccccgaaatagatgaaacatttaaagaaaaatacatctcattagtggagaccagaagagaatactacgaaggacccggaaagggttcaccatatggatgggatgcagatgtaaagaaatggtatcaacttatgatgggacactgtacgtatttccctgtcgaattcagaagtgtcaaatatgcatacacggcagatctctataacgcgttaaatgatctcaacaatctaacaatagcaagagacgataaccccaagctcgaataccacgaaaaataccatataatagaaaacgtcttcaaacaaaaaagaaacccaaccttaaaacaaatcgcaaaagagataggagtgaatgacataaacatctcaggataccgagtcacaaaaagcggaaaaccgcaattcacaagctttaaattatttcatgacttaaaaaaagtagtaaaagaccacgcaatactcgatgacatagacctattaaaccaaatagctgaaatacttaccatctaccaagacaaagattcaatagttgcagagctaggacaactcgaatatttaatgtcagaagcagataaacaatctatttcagaattaacaggatacacagggacacactcactatctctaaaatgtatgaacatgataatagacgaactatggcactcatccatgaaccaaatggaagtattcacctatttaaacatgaggccgaaaaaatatgaactaaaaggataccaaagaatcccaacggatatgatagatgatgcaatcctcagtccagtagtaaaaagatcattcaaacaagccattggagtagtaaatgcaataataaagaaatacggactcccaaaagacataataattgaattagcacgagaatcaaactcagcagaaaaaagccgatacttaagagcaatacaaaaaaaaaacgagaaaacacgagaaagaatcgaagcaatcataaaagaatacggaaatgaaaacgctaaaggattggtccaaaaaattaaactacatgacgctcaagaaggaaaatgcctatactcactaaaagatatacctctagaagacctcctccgaaacccaaacaactacgatattgaccacatcataccacgatcagtatcattcgacgacagcatgcataataaagtacttgtgcggcgagaacaaaacgcaaaaaaaaataaccaaactccatatcaatatttaacatcgggatatgcagatataaagtactctgttttcaaacaacacgtgttaaacctagcagaaaataaagatcgaatgacaaaaaaaaagagagaatatttactagaagaacgaaatattaacaaatatgatgtgcaaaaagaattcatcaatcgaaacctggtagacactagatacacaacaagagaactcactactttattaaagacatattttaccataaataatctagacgtaaaggtaaaaacaataaatggcagctttactgattttctacgaaaaagatggggatttaagaaaaatagagatgaaggttacaaacatcacgcagaagatgcactaatcatagctaacgctgattacttatttaaagaacataaattattaaaagaaataaaagacgtatcggacctcgcaggagacgaacgaaattccaatgtaaaggacgaagaccaatacgaagaagtattcgggggttactttaaaattgaagacattaaaaagtacaaaataaaaaaatttagtcatagagtagataaaaaacctaatagacaattaataaatgacacaatatactctaccagagtcaaggacgataaaagatatttaataaacacactaaagaatctatatgataaatctaacggtgacctgaaagaaagaatgcaaaaagacccagagagcctacttatgtaccatcatgacccacagaccttcgaaaagttaaaaatagtaatgagtcagtatgaaaatgaaaaaaacccactagcaaagtatttcgaagagacaggacaatatctaactaaatacgcaaaacacgacaatggaccagcaatacataagattaaatactacggaaataaacttgtagaacacctagatatcacaaaaaactaccacaatcctcaaaataaagtcgtacaactgagtcagaaaagtttcagattcgacgtgtaccaaacagataaaggatacaaatttataagtatagcatacctaacattaaaaaacgaaaaaaattattatgcgatctcacaagaaaaatatgatcaactaaaatcagaaaaaaaaataagcaataacgccgttttcatcggatcattctatacaagcgacataatagaaataaataatgaaaaatttagagttataggtgtcaactccgacaagaacaacctcatagaggttgaccggatagatatacgtcaaaaagaattcatagagttagaggaagaaaagcaggtcaattatatgaactctgattcatacctgaagaacaacagaataaaagtaacaataggaagaaaaaccacaaacatagaaaaattccatacagacatattaggaaacatgtacaaatcaaaaagaccaaaggctccacaattagtattcaagaaaggatga

SEQ ID NO: 4988 - RNA, 3195 nt, synthetic construct
  misc_feature 1..3195: note = Cas9 variant
  source 1..3195: mol_type = other RNA
atgtcagagtgcgtcacgaggcgaatattaggaattgacttaggaattgctagttgcggatggggagtaatcgaagtaggagaagcatccggatcaataattgctagcggagtacgatgttttgacgctcctttaattgacaaaacaggtgagcctaaatcagccacgagaagaaccgctagaggacaacgtagaataataaggagaaggagacaaagaatgaacgcagttcgaagactactagcagagtttggagtacttacagggcgatcgcctgacgccttacaccaagcattgctaaggttaagtcaaagtgtagctggaagtcaggtaacaccttggactctaagggcggcagctcatgaaagaaaactcacaaacgacgaattagcagtagtacttggacatatagcaagacaccggggatttagatcaaatagcaaaaatgacggaggtgcgaatgcagccgatgaaacatcaaaaatgaagaaagcgatggagacaacgcgagaaggactagcacgatatcacagctttggcgcgatgatagcgagcgacccaaaattcgctgatagaaaaaggaatagagataaagactacagtcacacggccaaacgttcagatcttgaagacgaagtacgcacgatttttcgaagtcaaacacggttcggtagcttagtagcatctgaaaaattaagtcaggcgtttgcagacgcagcgttctttcaacgacctttacaagatagcgaagacatggtcggttcatgtccctttgaaccagggcaaaaacgtaccgcaagacgagcaccgtcatttgaactatttagattcctaagcaggctggcaaatctcaaactgactgttggacgagcaccagaaagaagattgacaccagatgaaatagcactagccgcaaaaggtttcggagaaaccaagaaatcaataacatttaaatcattaagagaagcactagacttagatcctaatgcaagatttagtggcgtagcaaaagaaaaagagtctacattagatgtggcagcaagaactggcggagccgcatatggaactaaaactttaaaagatgcactgggggatgcgccgtggagatctttaagtagaatgcctgaaaagttggaccggatagctgaaatattatctttccgagaagatatgaaagccataaggaacggtctggaagaagtcgggcttgatggattagtggttgacgcactaatgcaagcaacggcaaatggagattttaaagatttcacaagagcagcacacataagcgcgcttgccgcaaggaacataattcctggattaagagaaggattagtatacagcgatgcatgcacaagagtaggatatgatcatgcagcacgaccggcagtgcccctatcccaaatcggttccccagttacaagaaaggctttaagtgaagcattgaagcaagtgcgggcggtagcaagagaatatggacccatagattattttcacatcgaactagcaagaagcatcggcaaatcagccgaagaaagaaagaaactaaccgacggaatagaagcgagaaatgtagagaaagaaaaacgaaggaaagaagctgccgagcatctaggtcgggcaccatcggatgatgaattgctaagatacgaattagcaaaagaacagaactttaagtgcatatattcaggagatcctatagacccagccgggatatctgccaatgacactaggtatcaagtagatcatatattaccgtggagtagattcggagacgatagttatgtcaataagacactatgtactgctagatcaaatcaaaacaagcgaggacgcacaccattcgaatggtttgacgcagataaaactgaagctgaatggatggaatatagtgcaagagtcgaggatctaaaagaagtaaagggtcgaaagaaaagaaactattctataaaagatgcggcatcggtagaagacaaatttaaagcaaggaatttaacagacactcagtgggcaacaagactgttggcagatgaattaaagcgaatgtttcctccaagagaatgtgaacgagtagtaactgtaagagcagatggcggaaatgatggactatcgatagtcgaagaaagaagagtattcacaagaccaggagcaatcacaagtaaacttaggagagcatggggactagagggattaaagaaacaagacggaaaaagagtagaggatgatagacaccacgcagtcgacgcattagtcttagcggctaccactgaatcactactaaatcggttaacagtagaagtacaacagcgtgaacgagaaggacgacaagacgacatatttcattgtagtcaaccatggccagggtttcgagttgacgtacagaggactgtatatggaagcgaaacaatgccaggaatattcgtctcaagagcagaaagaaggagggccagaggaaaagcacatgacgctactgtgaaacaaatacgagatattgacggagagagaatagtgttcgagcgaaaaccaattgaaaaactcactgataaagatttagaacgtatacccgtccctgaaccatatggaaaagcagcagatcctaaaaagttaagagatgaattagtagaaaatttaagagcttggattgccgctggaaaacctaaagataaaccaccaagaagtccgaaaggagatattattagaaaagttaggatcgaaacaaaagataaagtcgcggtggaaataaatggaggaactgtagatcgaggtgatatggcacgagtagatgtattccgaaagaaaaataagaaaggagtatgggagttttacgtaattccgatttacccccatcaaatagtagcgagtgccctacccccaaatagagcagtgatagcctataaagctgagtcagaatggactgcgattgatggttgttttgagttcgcatggtcattaaatccaatgtcttatttagaattagtaaaaagtaatggggagcttatagaaggttattttagatccatggatagaactactggtgcaatcaatttatcaccgatgtccaccaacagcgaaactataagatcaataggcgtaaaaacattgtccagctttagaaaattcacagtagatcgacttggtcgaaaattcgaaatacctcgcgaagtccgaacttggagaggggaggcatgtacatga

SEQ ID NO: 4989 - RNA, 3195 nt, synthetic construct
  misc_feature 1..3195: note = Cas9 variant
  source 1..3195: mol_type = other RNA
atgaaacgaacctccttgagagcatatagactaggagtcgaccttggtgcaaatagtctgggatggtttgtcgtttggctagatgatcatggtcaaccagaaggactaggaccaggaggagtaagaatatttccagatggtagaaatccccaatcaaaacaaagtaatgcagctggtaggcgactagccaggagtgcaagacgacgaagagatcgttaccttcaacgtcgaggaaaattaatgggtctgttagtcaaacacgggttaatgcctgcagatgaaccagcacgtaaacgcttagaatgtcttgacccttatggacttcgagccaaagcattagacgaagtacttcctttacatcacgtaggtagagcattgttccatctaaaccaacggagaggactatttgccaatagagcaatagaacaaggtgacaaagacgcaagtgcgataaaagcagcagcaggacgtctacaaacatcaatgcaagcatgcggagccagaacattaggtgaatttctaaatagaagacatcagttgagagctacagtacgagctagatcaccagtgggtggtgacgtccaagcaagatacgagttctatccaaccagagcaatggtagatgcagaatttgaagcaatatgggcagctcaagccccacatcacccaacaatgacagcagaagcgcacgacaccatcagagaagcaatattctcacaacgagcaatgaagagaccaagtataggaaaatgctcactagacccagcgacttcacaagatgacgtcgatggattcagatgtgcgtggtcacatccacttgcccaaagattcagaatatggcaggatgtaagaaatttagcagttgtcgaaacaggtccaacatcatcaagattgggtaaagaagatcaggacaaagtagctagagcactgctacaaaccgaccaattaagttttgacgaaatacggggattattaggattaccatcagatgcgagattcaatcttgaatctgaccgtcgagatcacttaaaaggggatgcaacaggcgctatactttcagccagaagacattttggtccagcttggcacgatcgctcattagatagacaaattgatatagttgcacttctagaatcagctctagatgaagctgctataattgcatctcttggtaccacacattcattagatgaagcagcagctcaacgcgcattatcagcattattgcctgatggatattgtcggttaggtttaagagcaatcaagcgagttttaccattaatggaagctggacgaacctatgctgaagcagcctcagctgccggatatgaccatgctttattacctgggggaaaactatcaccaacaggctacctaccatattatggtcaatggctacaaaatgatgtagttggaagtgatgatgaaagagatactaatgaaagaagatgggggagactaccaaatccaactgtgcatataggtattggacaactacgccgggtagtaaatgaactaattagatggcacggaccgccagctgaaataacagtcgaattaacaagagatttaaaattatcaccacgaagattagcagaacttgaaagagaacaagcagaaaatcaacgaaagaatgataaacgaacatctttattaagaaaactaggactacctgcatccacacataatttattaaaactaagactatgggatgaacaaggcgatgtagctagcgaatgtccatataccggggaagcaatcggacttgaaaggctagtctccgatgacgtcgatatagatcacctaataccattcagcataagttgggatgatagcgccgcaaataaagtagtttgtatgagatacgcaaacagggaaaaaggaaatagaacaccctttgaagcatttggacatagacaagggagaccctatgactgggctgatattgctgaaagagcagctagattgcctaggggcaaaagatggagatttggacccggagcacgagctcaattcgaggaattaggagattttcaagctagactgttaaacgaaactagctggctagccagagttgcaaaacagtacttggctgcagtaacgcatcctcaccgcattcacgtacttccaggcagacttacagcactactacgagcaacatgggaattgaatgaccttttgcccggatcagacgatagagctgcaaaatcacgaaaagatcatagacatcacgcaattgatgcacttgttgcagcactgacagatcaagcacttctaagacgaatggcaaatgctcacgatgatacaaggagaaaaatagaagtacttcttccgtggccaacgtttcgcatagacttagaaacaaggttaaaagctatgctagtctcacataaacccgaccatggattacaggcaagattgcacgaagataccgcatacggcacagtagagcaccctgaaaccgaagacggcgccaatctagtatatcgaaaaaccttcgtagatatatccgaaaaagagatagaccgaatccgagataggagactaagagacttagtacgtgctcatgtagctggagaaagacaacaaggaaaaacacttaaagctgcagtactatccttcgcacagagaagagacatagcaggtcatccaaacggaatcagacatgtaagattaacaaaaagtataaaacctgattatcttgtaccaattagagataaagcaggcagaatctacaagtcatataacgcaggagaaaatgcatttgtagacatattacaagcagaatctggaagatggattgcaagagcaacgacagtttttcaagctaaccaagcaaatgagagccatgacgccccagctgcccaaccaataatgagagtattcaaaggggatatgttgaggatagaccatgctggagctgaaaaattcgtcaaaattgtaagattgtcaccatcaaacaacctattatatttagtagaacatcatcaagcaggagttttccaaacacgacacgacgatcctgaagatagctttagatggcttttcgcttcatttgacaaattaagagagtggaatgctgaattagtaagaatagatacgttgggtcagccatggaggagaaaaagaggattagaaacaggatccgaagatgcaacaaggattggatggacccggccaaagaaatggccttga

SEQ ID NO: 4990 - RNA, 3198 nt, synthetic construct
  misc_feature 1..3198: note = Cas9 variant
  source 1..3198: mol_type = other RNA
atgaataaagacataaattacgcactaggattagacataggtattacatctgtcggctgggctgtaattaacttagatctaaatagaatagaagatctgggagtaagaatttttaacgcagcagaaaacttaaaagacggatcatcattagccctaccacgaagactagcaagaggacgaagaagactactcagaagaaaagcgtatagagtcgaaagagtgcgaaaattgatattaaagaacaatatattaacaaaagaggaactagaaggattattcaaaaataaagaagtgattgatgtgtgggaagcgagagtaaaagggctagattacaaactaagtcgtgaagaatgggccaaaatcttaataaatttttgcaaacgtagaggattcaaaagtaacaggaaaaacgaagctaaagataaagaagcaggccaaatactgtcatcaataagttacaacatagaaaagatgaaagaaacaaactcgagaaccataggcgaatacatatacaatgaagttaaaaacagtgaagacagttatgccccacttagaaacaaatttggagaatataaaatgtgtgtaagccgagatgtaatcagagaagaaatacatacgctatttgaaaaacaaagagaattaggaaacaacttcgcgtcagatgaaatagaagacaaatacttcgaaatattcaacagccaaagaccctttagcaactttgaagacctagaaaaactggtaggtttttgcacattcgaaagaaagaaacataaacgagcaccaaaacactgcatcagctccgaggagttcacgttatatgaagggataaataaactttccataataaaagatggagagaaaagaaaattaagtgaagaagaaaggacgctagtggtcaatgaagcatttaataagaaagaaatcaagtacacaacacttcgaaaattattagggttaagtgaagaagaattattttcaacactaacatatagtatagacaaagatattagcaaaaccgagaacacaaagttcgtatcactcaaaggatatcacgaaatcaagagagcgatagaaaaaggagtatcaaagaaagcgtggcaagatatagagaacaatagaaatctactaaatgatattgcatatgtattaacattaggaaaaacagatgacgaaattgaaaaacaactcagattaagaaatgtgcctgaagaattatttgaaagtctattagatatgagcttcaacaaattcaataatctaagtatatacgcactagagaaaatcctaccattcatgaaagaaggttatcagtacaacgaggcttgcgaaaaagccggatacaattttaaagccatatacgaaggtgtaaggacaaagaaattgccagttatagaaatagacgaaatagttaaccctgtagtaaatagagcattagcacaaaccagaaaagtaatcaatagcgtgatagacaaatatggaagtccggtaagaataaacatcgagttagccagagacttagccaaaaattttaaagatcgaaaactcatagaaaaagaacaaaaagaaaatcgtgcgaatctagataaaataagagagaatctgagggaattaatggacaaagaaccaacagttgtcgaagtactaaaatatcgattatgggaacaacaaagaggcgagtgtgcatatacgcaatcacaaataccactagagagactatttagtcccggatactgcgaaatcgaccatattataccgtttagtagaagttttgacgatagcttaagcaataaaatattagtactcggcagcgaaaaccaaagaaagggaaacaggacaccatatgaatactttggcgaagatagtgaaagatggaatagttttgagatctgggtcaaaggatcatatctaaattataaaaagaaagccaacctactaaagaagaaattctcagaagaagaacaaagggactggaaagcaaggaacctacaagataccaaatatatttgtcgttacatcagtaatttcgtaaacaatagactagagttcaaagaatcggagaacaaacagaaagtcataaccgtgaatggacgtgcaacagcgtatttacgttccagatggggcctgaacaaagttagagaagacggtgataaacatcatgcattagatgcagcagtagtaggagtaacaacacagggaatggtacagaaaataagtaagtacagcaaggcacatgaattgtacacagttaggaaaaatgatgagttcgtcgacgtggaaactggcgaatgcgtagacgtggatgaatacaaagaaatcagaaaagacatcttaccaagaccttggagaggattttcggaagaattgaaattaagactaagcgataatccgctcgaagaattaaagaaaagtccgatagaaacgtataacgaagagttcataaaagaaaatgtaaaacctatatttgtaagcagagtcccttttagaaaaatatctggaaaattattcaaagaaacgatatatagtgaaagagcttttaaagacggatattttgtaagtaaaaagagcttagtagatcttaaacgaggagacctagacaacttctacaactatgaatgtgataagaaactatacgacgctatttccgaacgcatgaaagaatttaactacaatggaaagaaagcgttcgaaagccccttccgaaaaccaacaaaaagtggaaaagaaggtccagttgtaaggagcgtaaaaataaaatccgcagtaccatttaaagatgggatccccatgaatgagggactggttgcgaaagaaggaatggtgcgaatagatatatacgaaaaagaaggtaaatattttgtagtgccggtatacagataccaattagctaaaggaatagtacctaaaagagcggcaatagctaagaaagatgaacttaaatggcctataatggatcagacttacaattttaaattctcaatctacaaaaatgacttaatagaagttaaatatgataagaaaggtgtatatttcggttattatgacggctttgatagaaactcagcgagcctaaccatagaaaaacacgataatagcgaaagatacagatctatagggttaaaagtaggagtattggaaataaataaatatgaagtggatgtcttaggtaactatcacaaagtaaaattaggaggaaattga

SEQ ID NO: 4991 - RNA, 3198 nt, synthetic construct
  misc_feature 1..3198: note = Cas9 variant
  source 1..3198: mol_type = other RNA
atgaacaaagatataaattacgcactagggctagatataggaataacaagtgtaggttgggcagtaataaacttagacttaaatcgaattgaagatttaggtgtgcgaattttcaacgcagctgaaaaccctaaagacgggtcatcactcgcactacctaggagattagcaaggggtaggcgaagactgttaagaagaaaagcctacagggtagaaagggttagaaaactgatagtgaaaaacaatattcttacaaaagaagaactagaaggcctattcaaaaataaagaagtaatagatgtatgggaagcaagagtaaaagggctagactacaaactaagccgtgaagaatgggcaaaaatattaatcaacttttgcaaaagacgaggatttaaatcaaaccgtaaaaatgagaccaaagacaaagaagctggacaaatactaagttcaatttcgtataatatagagaaaatgaaagaaacaaattcacgaacaataggagaatacatatataacgaagttaaaaacagtgatgactcctatgccccgctaagaaacaaattcggagaatataagatgtgtgtatcacgagatgtactaagagaagaaattcataccttgttcgaaaaacaacgagaattagggaataattttgcatccgacgaaatagaagataaatactttgaaatatttaattcccaaagaccatttagcaactttgaagatttagaaaagttagtaggattttgcactttcgaacgtaaaaagcacaaaagagcaccgaaacactgtatctcgagcgaagaatttacattatacgaagggataaataagctaagcatcattaaagatggagagaaaagaaaattaagcgaagaagaaagaaccctagtagtaaatgaagcattcaataagaaagaaattaaatatacaacactcagaaaattactcggcctcagcgaagacgaactcttttcaacattgacatactcgatagacaaagatataagcaaaacagaaaacacaaaattcgttagtttaaaaggatatcacgaaataaaaagagcaatagaaaaaggagtatcgaaaaaggcatggcaagatatcgagaataatagaaatctactaaacgacatagcatacgttctaacactcggaaaaacagatgatgagatagagaaacaattaagactccgaaacgtaccagaggaactattcgaatcgcttttagacatgagcttctcaaagtttaataacttatcaatctacgcactagagaaaatattaccattcatgaaagaaggctatcaatacaacgaagcatgcgaaaaagcgggatacaattttaaggcaatttacgaaggggttcgaactaagaaactcccagtcatagaaatagatgaaatagtgaacccagtagtaaacagagcactagctcagacaagaaaagtaataaacagtgtcatagacaaatatggcagtccggtaaggataaatattgaattagcaagagacctagctaaaaactttaaagaccgcaaactaatagaaaaagaacaaaaagaaaacagagcaaatttagataaaataagggaaaacctacgagaactaatggataaagaaccgacagctgtagaagtattaaaatacagattatgggaacaacaaagaggagaatgtgcatacacacaaagtcaaatcgctttagaaagactatttagcccaggttactgtgaaatagatcacataatacctttttcccgtagtttcgatgatagtttaagcaacaaaatcttagtgttaggctccgagaaccaacggaagggaaataagataccgtacgaatattttggagaagatagtgaaagatggaacagcttcgaaatttgggttaaaggaagctacttaaattataaaaagaaagcaaaccttctaaagaagaaattcaccgaagaggaacaacgcgattggaaagcaagaaatctacaagatacaaaatacatatgtaggtatataagcaacttcgtaaataacagattagagtttaaagaaagtgagaacaaacaaaaagtcattacagtaaacggtagagctacagcttacctaagaagtagatggggattaaataaagtaagagaggacggagataaacatcatgctctagacgcagctgtagtaggagtaacgacccaaggaatggtgcagaaaatatcaaaatattccaaagctcacgaactatatactgtccggaaaaatgatgagtttgtagacgtcgaaacaggagaatgcgttgacgttgatgaatataaagaaatcagaaaagacatactacctagaccatggagaggattttcggaagaactaaaattaagattatcagacaatccgctagaagagttaaagaaactaccgatagaaacatacaatgaggagtttatcaaagaaaatgtaaaaccaatattcgtgagtcgagtaccatttagaaaaataagtgggaaactgttcaaagaaacaatctacagcgaaagggctttcaaagatggatattttgtcagtaagaaaagcctagtagatctcaaaagaggagacctagataatttctacaactatgaatgcgacaagaaattatacgatgcaataagcgaacgaatgaaagagtttaattacaatggtaagaaagcattcgaaagccccttccgcaaaccaaccaaaagcggaaaagaaggaccggttgtaagaagtgtaaaaatcaaatctgcagccccgttcaaagacggaataccaatgaatgaaggattagtagccaaagaagggatggtaagaatcgacatctatgagaaagaaggtaaatattttgtagtaccagtatatcggtatcaactagcaaaaggaattgtaccaaaaagagcagcaatagcagggaaatcggaattaaaatggcccataatggaccaaacatataatttcaaattcagcatttttaaaaatgatctaattgaaataaaatacgcaaagaaagatggatactttggatattacgatggatttgacagacacacagccagcttagttatagaaaaccacgataattccgatagatatcgaggtatcggcgtaaaaacaggagtagtagagttcaacaaatacgaagtcgatgttctaggcaattatcataaagtgaacttgggaggtaattga

SEQ ID NO: 4992 - RNA, 3201 nt, synthetic construct
  misc_feature 1..3201: note = Cas9 variant
  source 1..3201: mol_type = other RNA
atgtcagaacgagttgtacggagaatattagggatagatttaggtatagcatcctgtggatggggagtagtagacatatctggcgctggtggaggcataatcgcaacaggggttagatgttttgatgcaccactgattgacaaaacaggggaacctaaaagcgcaacacgacgaacagcaagaggacaaagaaggatagtacgtagacgaagacagcgtatgaatggagtacgaagattgttatgcgaatttggtttgttacccgacccaagacccgacgcattaaatcaagctatgcgtagaatcagtacagcatcagcagcagcgcaagtaacgccatggacactcagagcagctgcacaccaacgcctgttaagtaatgaagaacttgcagtagtattaggtcacattgctagacataggggattcagatcgaacgctaaaaatgaagcgggagcaaacgctgcagacgaaaccagtaaaatgaagaaagcaatggaagcaactagagaaggactagccaaatatcatgcatttggagatatgatagcaaatgatcctaaattcgcgaatcgcaaaagaaatagagacaaagactattcacacacagcaaaaagaagcgatttagaagatgaagtgagagctatattacgagcacaacttagatttggtagtgcagctgcaacggaaaccttagcacaaacatttgcagacgtagctttcttccaacgaccattacaagattcggaggatagagtaggcgattgtccattcgagccaggacaaaaacgagccgctagacgagcaccaagttttgaattatttcgatttttgtcgagactagcgaatctgaaactagctgtgggacgaagtcctgaacgacgacttacggcagaggaaatagctttagcagcgaaaggcttcggagaaactaagaaaacaatcacgtttaaatcacttagggaagcattagatctcgacccgaatgccagattcagtggtataggaaaagacaaagaagcatcattggatgtagtagcaagaacaggcggcgctgcatacggaaccaaaacactaaaagatgcgcttggtgatgctccgtggagatcacttagccgaacccctgaaacgttggacagaattgctgaaatactatcatttcgagaagatatcacaagtatcagaaatggactagaggatctagggttagactcattagtagtagaagcattaatgcaagccgcggcaaatggcgatttcaaagagttcacaagagctggacatatatctgcgagagccgcccgaaacataataccaggcctacgagaaggtctagtatattcagaagcatgtgccagagtaggatatgatcatgcggcaagattatcagtgccattagatcaagtaggatctcccgtaacaaggaaagcattaagcgaagcacttaaacaagtcagggcagtagcaagggaatatggaccgatcgattattttcacatagaactggctagatccgtaggtaaaagtgctgaagagaggaaacaattgaccgacggaatagaagcccgaaatgttgaaaaagctaaacggcgcaaacaagcggaggaacatcttggtagagcaccatcggacgatgaattattgagatacgaactagcaaaagaacagaacttcaagtgtatatattcaggagacgctatagacccagctggagtagcagcaaatgacacaaggtaccaagtagaccatatattaccttggtcaagatttggagatgactcttacttaaataaaacgctatgtactgcaagaagcaatcaaaataagagaggtcggactccatttgaatggtttgaagctgataaaacagacgtagaatggatggaatacgtagcaagagttgaaaacttacaagaagttaaaggtcgaaagaaaagaaactattctattaaagatgcggcagcaatagaagataaattcaaagccagaaacctaacagacacacagtgggcaacaagattattagcagacgaactaagcagaatgtttccaccaagagaatgcgagagagcgatttgtggtagggcagacggaggaaacgacggattaaccatagtcgaagagagaagagtatttacaagaccaggtgctatcacaagcaaattaaggagggcatgggggttagaaggattaaagaaacaagacggaaaacgtgtagaagacgaccgacatcacgcagtggacgccctggtattagcggcgacaacagaatcattattacagagactaactgtagaagtacaacgaagagaaagggaaggacggcctgatgacattttccattgcgccgaaccatggagagggtttagagctgatgtcagacgcacagtttacggaagtgaaacgatgccaggaatttttgtatcaagagcagaacgtagacgagccagaggaaaagcacatgacgcaacaataaaacaaatacgtgaaattgaaggagaaagactcgtatttgaaagaaaacctgtggaaaaattaactgataaggatttagagaaaattcctattccaaaaccctatggtcaagtttcagaccccaaaaggttaagagatgaattagtagaatctctacgtgcatggatagccgcggggaagcctaaagacagaccaccgttatcaccaaaaggagatgtcatcagaaaagtaaggatacaaacgaacgacaaagtaagcgttgaaattaatggaggaaccgtagatcggggcgacatggcgagagtcgatgtgttcagaaagaaaaataagaaagcggtatgggaatattacgtagttccaatatatccacaccaaatagttgcgttaaatgacccaccagatcgagctgttattgcttatgctgaagataaagattggaaagaaatagatagtagctacgagttcctgtggtcattattcggattaagctacgtagaaatcagtaaagctaatggcgaatgcattgacgggtatttcaggggattacatcgaggtacaggagctgcttcagtatgcaaacacattagcttaggaaaagatgctacagttagcggaataggcctaaaaacacttgcatcatttaagaaatttacaatagacagactgggaagaaaattcgaaataccacgggaagtaagaacatggagaggagaggcttgcacctga

SEQ ID NO: 4993 - RNA, 3201 nt, synthetic construct
  misc_feature 1..3201: note = Cas9 variant
  source 1..3201: mol_type = other RNA
atgtcacacctagtcttaggactagatttaggaccaaattcaataggatgggcgttagtaaatgacgacccggaacatccggtagaatcaaaattagttgacttaggagttagagtctttccagaaggagtcgataactttgacacatctaaagaattgtcacgtaatgaagataggagagtggcaaggggaatgagaagacaaataaggcgcagagcaagaagaagacaacaattaaaacaagcgttaatagattcaaaactatggcccagtgaccctaatgatgaagttgttctatacaatacaaatccatacgaattgagagcgagagcactcaaagaacggctagaaccacacgaggttggtagggtattactacacttgaatcaaaggagaggattcctgagcaatagaaagaaagacagaggggacaaagaagtacaaggaatgttagcagaaataaatgaaaacgaacaacaatgtaaagacggagggtttgacactataggtgcttggctagctgacaaacaagcaaatatagaccatgctaaccgagaagagaacgatcatgtcagaaatagacacctagcgagaagtcagtacgtagacgagtttgaagctatttggagtgttcaagcaaaacatcatccgaaactactcacagaagaactaaaagttggcaaattaggaaaacaaacttacccagtcaaaccgatacctagatggcatgaacatagacaagggctatccccactagaatcttttggaatatatggtctcatatttttccaaagaccaatgtattggccgaaatcagtagtaggactatgtgaactggaaccaaaagagagaaggtgccagcgaagcgatcgtagacaacaaagattcagactcttacaagaagtaaataatctaaaatacgttgatcctgatacacatttagaacaaaaattagacgacaaacaaagacgattattattggataaacttagccatactaaagaaatgacatttgaccaaatacgaaaagcactagacttcttagaatctgtaaaatttaacctcgaacgaggggaaagaagtagactaaaaggggtacctatagatgcactatttgccgcaaaggacgtactagggcaagagtggtatgacagacctgaacaacagaaaaccgaaatagtagcagtattactagataacgaacgggacgacgatcgaataatcgcaagagcagtcgcagagtggggaatgacagccaaggaagccgaagcaatgcttggtgtcgacctgcctgcagggtatgcgaacttaagttgtaaagctatagaaaaactcttaccgcatatggaaagaggtctactctatatggacgatgatgaatcaaattcagctatgcatgcagccggatacttacgacgagaccaactacgtagaagaattttcgatgtattacccgatccggcaagaacaccaaactgtccaataggcgatataccaaatccagtagtaaaaagaaccctaactgaaattaggaaagtagttaatgcaatagtaagagaatatggaaaacccgatgccatacatttggaactagcaagatcagtacaaatgggaaaggagaaaagatcagaatattcaaaaatgattcgggacagagaagcagaacgcgatggaatagtagaaaagttaagagaaagcggagtaagggtgacaagagacaacatactcaagtaccagttatgggaacaacaaaatcaagaatgtatttacagtggcaaacccattagctttgaaaaattatttggggagggaggtggtgtagaagtagatcatatactaccccgctctaggtcactagacgacagtcaagcaaataaaatagtctgcctaagaacggccaacgctggaaagggcgatcagacaccatatgagtggctcgccgatacacagccaaaacaatacgaacaagtgtgccaaagagcagggatgttaatgaggagtggaagaatgccatatgcgaaatatagaagatttattcaaagagaacttgaactcgacaaatttatagcaagacaattagcagatacaggatatataactaaagcgacaatggaatacctaaggtacctctttgataaagaccatgatgttttaggattgaagggacaactaacagcagagcttagatatcactggggtctcgaaacaatacttgaagaactaccagattctccagcatggcatgaagctgacagtggaaaattaagaccaggtgagaaaaacagagctgaccacagacatcatgctattgatgccgtagttattgctctaacaaatagaagacgacttgtacaactatctgatatagtaaaacgtggaggagcacgggcacatggagaaatcttagaagacccttggccaaattttagagaaaatgtagtccaagctataaagaaaacaaacgtatcacaccgagtagaaagaaaagttgcaggaaaattacacgaagagacattatacgggccaacacgaacaccaggggaatgggtactaagaaaacctgtcatagctctatctgcaaatgaggtagaaagaattagagatgctacgattagacaaatagtagtgagcgcactagcagatgctggtattgatgtcgggcgaggaaagaaaccagacgctaagaaaatgaaagaagcattatcaaaattaaaaatgcctagtggagttccaatacgaaaagtacgtctaacaaaaccagaacagaccatacaacctgtaagagccggcagacctgatcaggcttttgtcaagcctggtagtacacatcatttatgcatttttgaatttacagaaaatggaaaaacaaaacgagatgcagtattcgtaacaatgctagaagcaatgaacagactaaaacgacgagaaccagtaatacaaaggactcatcccgaacgcccagacagccgatttgtaatgagtttgagcgcaagagaaatgctacttgccaactggaaagatggtgaaagattattaacattcaaaacagcaagtagcactcaaggacaaatttggttcgctgaacacacagatgctagaaaatcagcagattataagcaatttgttgcgaacgcaaataccctagatgcaaagaaagtcacagttgatccattaggcagaatccggtgggcaaacgattga

SEQ ID NO: 4994 - RNA, 3204 nt, synthetic construct
  misc_feature 1..3204: note = Cas9 variant
  source 1..3204: mol_type = other RNA
atggggactagactaggactcgacattggcacaaattcgattggttggtgtttatttaacctcgacggaagtggaaggcctataggaatcagagatataggagttaggatattttcagatggtcgggatccaagaagtggtgctagtcttgcagtggagcgacgagtagctagagccatgcgaagaagacgtgaccgatatattaggagacgttctgccttattggaagcattaattaacacaggcttaatgcctgcggatgtacaagaaagtaaagcattaacaggatgtgatccatatgttctcagagctcaggcactagatcgagcattagatgcacatctactaggaagagtattatttcatttaaatcaacgaaggggatttaaatctaatagaaaagcagaaagaaaagcaggcgatgataaagaagggggaaaaatagcggacggagcaaaagcactagatcttgcaatgcatgaagcgggagcaagaacatatggtgagttccttgccggacgagatagcaggagagtaagacttagagcagaaggagacggatatgatttctacccagaaagaagacatttagaagcagaatttgatgcaatatgggacgcccaggctgcatacaaccctgcccttttaactgacgtagtgagagacagattaagaagaataatattctttcaaaggccacttaaagcaccaaaggtaggaggatgcaccttctttaatgaggaaccacgattaccaaaagcacaccccctctttcaagaaagaagactatatgaagaagtgaaccaactagaaataacaagggctggagcaccttcaagaaaactaacattagatcaaagagataaaataattaggaaattaaaaagtgcaaaaacagcctctttctcaggactggcacgactgttaaagttagcagatggtgaatcattttcaagagtaacagaaaatagaacagggctagcaggagatgatatatttacgtcatttagtgataaaagatgtttcggagacagatgggcacatttcgatccgggagttcaatggtctataatagaaaccgttacagaagaagaggatcctgtcagattacgagattggttaatggctacacatggagtcacagttgaacaggcagaagcaatcgggagagtacgcctcccggaaggacacgggagacttggagaaacagcgagtagacttatacttgctcaattaaaatcaggcagcaaagatggacaccctttaacatataacgaagcagtagaagctgctctaggtaaatcgcattctgattttaggacaggagaaatattagaacaattaccatattatggtgaaattctatcaagagaaatcccacccggaagtttagatcctgatgatgatgatgaaataaggtggggaaagataactaatccaacagtacatatcggccttaatcaactcaggagactgcttaatgctttaataaaagcacatggacgcccagatgaaatagtagtagaattggcacgagagttaaaattgtcagaaaaagacaaggctgagcataatagaaggataggagcgaatacccgagctgcggaagcaagatcaaagaaattactagaaagtggccagccggatactggtgcaaacagaagcctcctaaaactgtgggaggatctaaacccaaacaaccctttagacagatgctgtcctttttgtggaagacacatagggcagatggctctatttagtggcgaaacagaaattgaacatataataccatacagcagatcgttagatgacagcgcggcaaataaagtgatagctcaccgcagttgtaacagagagaaaggaaacagaacaccatgggaagcctggggtcatacagaacgttgggcaataatagcagaacaagtcagcaggctccacaaatcgaaacaatggagatttgcaccagatgctattgagagatttaatcaagaaggaggattcatagcaagacaactaagtgatacacaatatttaagccgaatggcaaggacatatttatcttcattatatccggatacagcgggtgtatacgtaataccgggtaggatgacggcaatgctacgacgtctgtggggtttaaacgaattattgcccgatcacaattatgttgagaatccgcatagtggagcaccgaaaaacagattagatcaccggcaccatgcgatagatgccgccgtagtaggtgtcactacaagaggattactaaatgaaatatcaagagccgctggacgagccgaacggcaagacttggacagactcttcatcgatctaccaaaaccatgggaaaccttcagagaagatctgcacgaaagtttagcgagagttgttggatctcacaaagcagatcatggccgaaaaggagtaccagcaaaaggaaaagacgcaaccgcagctagactacataatgaaacagcttacggactcaccgggttaaccagtgagagtggtcttccaattgtagtacatagagtaccattactatctctaaaacctgatgatttaagcaatccaataagaatacctgatgcagcattacaacgggctctcagagaggctaccgacggtaaaagcggaaaagatttccaagaagccttggctcaattcagtaaatccgaccctgtatttaagggaataaggcatgtaagggtgcgagaaacactaaaagtaataccaattcgagatgcatctgggcatgcgtttaaagcctataaaggagatgcaaatgctcgatatgatgtatggagaatgccagatggaaaatgggtttcaagttggagagatagagatggtaaagcccatagcggaataataactatgtttgcagcacatcaagcaggtcaaccagtacaaaggcctcacccagctgctaaaagagtacttagtttaagacaaaatgatctcgtggctgtagaacctcaaggccaaccaagaaaaattatgagagttgttaagttttcaagtggcggacagataacgttcgcagaacatcaagaggcaggaccactaaaagcaagggatgcaaccagtccagatattgatcctttcaaatatttttactcttctgctggtggtctacaaaaagcgagggcaagacaaatacgaatagatgagcttggtcgaattttcgacccaggccccagatga

SEQ ID NO: 4995 - RNA, 3207 nt, synthetic construct
  misc_feature 1..3207: note = Cas9 variant
  source 1..3207: mol_type = other RNA
atgaaatatgttctcggactagacataggtatagcatcatgcggatgggcggttataaaccaggaaaaacacagaatagaggacttaggcgttcgtatattcgataaagcagaaaacccaaaagatggaaagtccctagccacaccaagaagagatgctcgatcaacacgaagaactctaagaagaaaaaagcaccgcatgcaaagaatcaagatactcctggttaaacatgggcttctgtcaaaaacagaaatagatcacttatacgagagcgcaactgaaattgatgtctggtatctaagactcaatgcactagaacgacggctaaaccctaaggaattcgctagagtattaatacacttaagtaaacgtagaggctttaaaagcaacaggaaagaaacaaccctctcagaaaatggacaaatacttgaaaacatatccgaaaacctacaaataatggaacaaaaaaattatagaacagttggggaaatgattctcaaagataagagattcgaaaatcacaaaagaaacaaagatggcacatacataggaacagtcacacgacaacaactacaagaagagatacaaatgatatttaatgctcaaagactatataaaaacaatcacgcaactgaaaaatttgaaagtagttatctcgaaatttgggcatctcaacgaccctatgcctctaaagaccaaattgaaaaaatgatagggtactgtaccctcgaacccaaagaaaaacgagtacccaaagcctcatggtcattccaatacttcgtcgcactccaaacaataaataatctaagactaataagcaaagatagaatagaagaactctcattcgaagaaaaaaaacgaataatgaacctagcattagaaaaatccatagttaaatatatagacataagaaaactattatccgtaccaaaagagtttcaattcaacagtctctcctattcagcagacatagtcgatacaaccgtagaaaacaaaaaatgtatagaactaaaagagtatcactccatcaacaaggtatataaacaaatctatggacaaaatgcactaaacctactaccgaaagattatgacacaatcgcatatggactaacaatcttcaaagacgacaaagatatacaagaatatctacaaaataaatatgtaaatgcaaaaggaaaacccatttcaaatctagcaaataaaacttacgacgacacatttatacaagtcctccttacactcaacttcagcaaaatgggtcacctctccttcaaagccctcaaaaatataatccctttcttagaagaaggactcagttacgacaaagcttgcgaaaaagcaggatacaactttaaaggcacatcttatacgaaaaaaacgaaatacctccccgtaataccccaaaacacaaacccagtagtacatcgtgcgctatcacaaacaagaaaagttataaatgcaataataaaaaaatatggatcacccaatgcaatacacatcgaaactgcacgagaactaagtaaaacctttcaagaaagaaaagaaatagatagcatgtatcaagataactcgaaaaaaaatgaacatgcaatatgtaaactaaaagagctaggaaacataaacccaagtggtatcaatatagtaaaatttaaactctggaacgaacaagacggaagatgtatgtacacaggaaaatacattgaaccccatagattattcgaagagggatatacagaagtcgatcacatattaccatactctagatcccttgacgactcatataataataaagtactcacactaggtactgaaaaccagagaaaaggcaataaaacaccttacgagtacatgagaaacaattctatctgggacgaatttgaaactagagtacagtcaaataaaaaaataaacaaaaaaaaacaacaaaaattattgctacagaacttctcacacgcaagagaacaagaattcatcgaacggaaccttaacgatacgagatacgcaactatatacctctcatctctcattcaacaacatctaattttttccgaatcctcgcgagaaaaaaaagtacacacagtatcaggtataataaccagtcacctacgttcaagatggggattcaacaaagataggaaagaaggacacatacaccatgccttagatgccgtaatagtcgcagtaacctctgaccatatgatacaacgagtcaccaaatattacaaacttaaagaattaaacagaaatagacaagccaaaagaatgcagttcccagaaccatgggaaggttttaggctagaacttgaagcacgtatatcgccaaatacacaacaatacttaaaaggcataagattcaaaaactacgccgacgtaaacctcagcgaaatcaaaccaatattcgtatcacgtatgccaaagcgaagtatcacaggggaactccatcaagaaactattagaaaattcctcggctataatgaaaaaggaaaagttttaacagcaacaaaaactaaacttgaagacatcccattcgacgcgaacggagactttcctatgtttggaaaagaaacagacctatacacatacaacgccataaaagaacgatatttatcccacaaaaaagataaatctaaaagttttcaagaaccattatataaaccaacaaaatctggaggtataggaccactaatcaaatcaataaaaataatggatacccgaacaatagtaaacccagtaaatcaaggaaaaggagtagtatataatagcaaaatagcacgaaccgacgttttcaaaaaaggagaaaaatactatctaatcccaatatacacaatagacctaatgaaaaacacacttccccagaaagcaataacagccggaaaaggatacgaagattggacaactatagatccatcattcacgtttctattttcactatttcccaacgatctaatacaaatagtcccatccaaaaataaaacaataaaagccagaacaacagtaagtaagaaagaggtactactaccaagccttaccgggtacttcaaaggagtccactctggaacagcaggaataacagtcgaaacccacgacggatcaataattgcaaatgtcggaagcaaacaactattatcattcgagaaataccaggtagacgtattagggcactatacaaaaatcaaaaaagaaaaaagaattggcatggcaatatga

SEQ ID NO: 4996 - RNA, 3207 nt, synthetic construct
  misc_feature 1..3207: note = Cas9 variant
  source 1..3207: mol_type = other RNA
atgaataaagcagtagcatataggctagcactagatctaggatccacatcgctaggttgggcaatctttagacttaacgaagcaagagaacctaccgcaataattcgagcaggagttagaatattctcagacgggagaaatgccaatagtgaaccactagcagttcacagaagagtggcacgggcaatgagaaggagaagagacagactactaaaaagaaagaaaagaatgcatgaccaacttgtccaacatggctttttcccagcagaagtagcagagaggaaagaacttgaaagactaaatccatatcaactacgagctaaaggtctacatgaagcgttgacacccggtgagttcgcgagagcattatttcatataaatcaaagaagaggttttaaaagcaatagaaaaactgataggaaagacaatgattcaggagcattaaaacaagctattagcgaactcagaaaaagaatacaggacagtgattgtgcgacagctggagaatggttttggaaagaacgaatgcagcaaaaaccagaaggagttaggggacaatgggttagggcaagatatagaaaaacaccctcaacaacagatgaagggaagaaacggataggttatgacctatatgtcgatcgagcaatggtggaacaggagttcgatgctttgtgggcagcgcaagctgctttgcaaccgggcttattcacagaagcagcacgtgcagaactaaaagacactctactatatcaaagagatctaaggcccgtaaaaccgggacggtgcacgctcttaccggcagaagaaagagcaccactcgcattgccttcaacacaaagatttcgaatactacaagaagttaataatttaagactactagatgaggctttaagagaagttccattgaacctagctcaaagggatgcagttgtatctgcgctagaaggaaagaaagaactatcgttcgcagccattagaaaattattgacattaagcgggaaatttaatttggaagatgagaaaagagcagaattaaaaggtaatgcaacgtcagttattttggcacgaaaggatttgtttggagacgcttgggctggatttgacgcagcagtacaagatgaaattgtttggagattagtatcacaagaaagtgaaggggcattaatagcatggctgcagcagcacacaggagtagacggcgtttgtgcagaggccatagttaatacaaggttacctgacggttacggtagactatcaaggaaggcgttggaaagaatagtaccagcactacaacgtgaagtctgtacatatgacaaagcagtacaagcagcagggttcgcacatcactcagatctaggatttgatttcgattatgctgaagatgaagtacaacaagtaggagaacacacaatagcaagtactggagaagtccaggcacaatatgcgttcaaacaattaccctactatggaaaagcattacaaaggcatgttgcctttggtagcggagatgcaaaagaccatgaagaaaaatgttatggaaaaattgctaaccctacagtacatataggattaaaccaagttagaacagtggtaaatgcacttattagaagatatgggcatcctacagaggtagtagtagaattagcaagggacctaaaacaatcaagagaacaaaagcagcaaacccaaagggagcaagctgataatcagaaaagaaatgaagatataagaaaacgaatagcaccaatactggaaacatctccagaacgagttagggacagagacataaagaaatggatcctttgggaggaactgaataagaaagacattgctgatagacattgtccctatagtggggaaagaatttccgcaactatgctcttaagcgaagcagtagaaatagaacacatcttgccatttagcagaacgctagacgattcattaaataacagaacagtcgcaatgagacgagcgaacagaattaaaggagaccggacaccatgggaagccagagcagatttcgaggcacaaggatggcgatatgaagctatactccaaagggccgaaggaatgccccctagaaaaagatatagatttgcagaagatggttaccaacgatggttaggtaaagaccggaacttcctagcaagagctttaaatgacacgagctatttaagtcgactagctgctaattacttaagattagtttgcccacaaggagtaagagtaattccaggacaaatgacagataaactaagaggaaaatttggtctaaattcagtactaggattagatggtaagaaaaatcgaaatgaccacagacaccacgcagttgatgcctgcgtaatcggagtaacagaccaaggtttgatgcaaagatttgcaaatgcttcgaaacaggcaagagagaatgggttaacaagattggtacaagatatgttactaccttggtggccatcatattacgatcatgtagaaagagccgttagacatatcagggtaagtcaccgacccgatcacggatttgaaggcgctatgatgaaaggtacagcacatggaattagagaagatggaattagagaagatggaagaataaaacagagaccaaaagctaaaggctcagcagaccataaaaccatcacattaataccaatagatgaaccacgacaattggcaagacacggtgtagatgcagagggaaaaccattaccatataaaggatacgcatcaggaagtaattattgcatcgaaatcacgaaaaatggcaaaggtaaatgggagggtcaagtgatatcgacgtttgatgcatatagaatcaaagctgcagcggatgctgcggcaagggcaggtcaagtaatatcaaccgtagaggcagatagtatagtacgcaaatctggttgggagaggttaaggggcgcacaatcacaaaacggtcagccattggtcatgagattagtgataggcgatagcgttagaatggaagtcgatggtcgagatgaagtaatgagagtagtaaaaatgtctggaaaagaaatggtcttcgctccagtaagagaagctaacgtggataaaaggaataatatgccagatgaacaggatccatttacttatacctataaacgggcagaccaactacgtaaagctaaagccagacaagtaacgataagtccaatcggtgaactacgtgatccagggttcaaaggatga

SEQ ID NO: 4997 - RNA, 3207 nt, synthetic construct
  misc_feature 1..3207: note = Cas9 variant
  source 1..3207: mol_type = other RNA
atgcaatacgtgctaggccttgatataggaatcgcatcctgcggatgggcagtaattaaccaagaaaaagaaagaatagaagatctaggggttcgcatattcgacaaagccgaaaatccgaaagatggaaaatcactcgcggcaccacgtcgcgatgccagatcaacaagaaggacattaagaagaaaaaaacaccgaatgttaagaataaaaatactcttagtaaaacaaggactcctatcgaaaaatgaactaaatcatttatacgaatcaacgacagaagtcgatgtgtggaatttacgtcttgacgcactagaaaggaaactaaaccccaaagaatttactagagtattgatacacctcgctaaacgaaggggattcaagtcaaacagaaaggaaactacactatcagaaaatgggcaaatattagaatctatctcagaaaaccaacaaataatggaacagcaaaattatagaaccgtaggagaaatgatcttaaaagacaaaaaattcgaaaaccataaaagaaacaaagatggaacctacatcggaaccgtcacacgacaacaactccaagaagaaatacaaatgatattcaccgcacaaagattatacaaaaacgactatgcaacagaagaatttgaaatctcctacttagaaatctgggcaagccaaagaccatacgcttctaaagaccaaatagaaaaaatgatcggatattgcacactcgaaccaaaagagaaaagagtaccaaaagcctcttggagctttcaatattttgtagcgctacagacaatcaataacctacgattaatatcaaaagaccggatagaagaattgagctttaaagaaaaaaagcaaatcatgaacctagcactagagaaatcaatagtcaaatacattgacattagaaaactactaagcataccaaacgaatttcaatttaatagcttatcatacagcgcagacactgtagatacgacacttgaaaacaagagatgcatagagttaaaagaatattattcaataaacaaggtttataaacaaatctatgaaaaaaatgccttaaacctactcccaatagattacgacactatagcatacggtttaacaatattcaaagatgataaagacattttagaatatttacaaaacaaatacgtgaatgccaaaggtaaacctataaacaacctagcaaaaaaaacctacgactacacctttatacaagcgcttctgaccctaaacttcactaaaatgggacacctaagcttcaaagctcttaaaaacatcattccatttctagaagaaggactctcatacgacaaagcctgtgaaaaagctgggtataattttaaaggtacatcatatactgaaaaaacgaaatacctacccgttatacctcaaaataccaaccctgtagtacacagagcactatcgcaaacaagaaaagtcataaacgcaatcatcaaaaaatacggatcaccaaacgcaatacatatagaaacagcccgagaattatctaaaacattccaagaaagaaaagaaatcgactcaatgtatcaagacaattcaaaaaaaaacgaacacgccatacataaactcaaggaattaggcaacattaacccatccggaatcaatatagttaaattcaaactttggaacgaacaagacggaagatgcatgtactccggaaaatacatagaaccacacagacttttcgaagaaggatatacagaagtcgatcacattctaccttatagtcgctcactagacgactcatacaataacaaaacgctcacattaggaaccgaaaaccaacgaaaaggaaataaaacaccatacgaatatatgggaaacacaagcatatggaacgacttcgaaacacgagtacacagcaacaaaaaaattaacaaaaaaaagcaacaaaaactcctactccaacacttttcatacgcaagagagcaagaatttatagagagaaacttaaacgacaccagatacgctacaatatacctatcaagcctaatccagcaacatctaatattttcagaaagctctagaaaaaaaaaagttcacacagtaagcggaatcatcacctcacatctccgatcacgttggggatttaataaagaccgcaaagaagggcacatacatcatgcactcgacgcagtcattgtagcagttacctcagatcacatgatacaacgggtaaccaaatattacaaactaaaagaattaaaccgaaatctacaagcaaaacgaatgccattccctgaaccctgggagggtttcaggttagaactcgaagccagaataagcccaaacacacagcaatacctcaaaggattccgattcaaaaactacgcggatgtaaacctaagtgagataaagcctatattcgtatcaagaatgccaaaacgatcaataaccggagaactacaccaagaaacaatccgtaaattcataggatacaatgaaaaaggaaaagtacttaccgcaattaagacaaaactcgaagacataccatttgatgcaaatggcgactttccaatgtatggaaaagaaacagacctatacacatacaacgcaataaaagaaagatttctatcacacaaaaaagataaaagaaaatcattccaggaacctctatacaaacccaccaaatcaggaggaattggaccactaataaaatcaattaaaattatagacactcgcaccatagtcaaccccgtaaatcaaggaaaaggggtagtgtataacagcaaaatagcaagaacagacgtatttaaaaaagatgaaaaatattacttaatacccatttacacaattgatctgatgaaaaacatattaccacagaaagctatcaccgccggcaaaggatatgaagactggacaaccatcgatccgtccttcacatttctattcagcttgttcccaaacgacctaatacaaatcgtaccatccaaaaataagacaataaaagcccgaaccacagtcagcaaaaaagaagtactactcccgagcctaaccggatactttaaaggagtacactcgggaaccgctggaatcacggtggaaacccacgatggttcagtaatcgctaacgtgggctcaaaacaactattgctaattgagaaataccaagtagatatacttggccattacacaaaaattaaagaagaaaaacgaataggaatggcaatttga

SEQ ID NO: 4998 - RNA, 3207 nt, synthetic construct
  misc_feature 1..3207: note = Cas9 variant
  source 1..3207: mol_type = other RNA
atgcctaaatccgctaaaccacaacaagcctatacactaggtctcgatataggcatcgcctcagtaggggcagccctactaggacaacagcatataatcggactacatgtccgcacgtttgatagggctgaaactgccaaagaaggagagcctctaaacaaaataaggcgggacgcacgtctgacaagacgtaggttacaacgtagagcacatagattattaagattgagaagattatttaaaaggcataacctaatacccgatactgacacctctacatttatatcaggacaatctccatgggaactaagagcccaaggcctagacagacaattaaccagtgcagaatggactaccgtactatatcatatagtaaaacaccgtgggttccattcaaatcgtaaaagcgaagtaaaaaccgatgaaaaagctggccaaatgttgtcaggcgtaaaccaaaaccaagctctactaaaacaaagtggattacgaacgatgggtgaacttgcagctagacacgaggctttccgtgaagctaaaaggaataagaaaggtgcatataaccatacatttagccgacatgacttagaagacgaactacatttattattttctcgacaacgtgaattaggaaatccatacgcaacaccagaattagaagatgccgtacatacattattaatgcagagacgacccgcattatcaggaaccaacttgttaaaaatggttggacactgcacattagaaccagatgaatttagagcaccaaaagcatcatataccgcagaacgattcatatggttaacaaaattaaataacctccgagttagtggatctggtgaaacccgtcctctaaatgaatccgaaagacaggcgctcctaagcaaacccttttcacaatccaaattgacatataaacaggtacgaaaaatcctagaactaccggataatattcgatttgtaggtctacattatcatcccgcccaagacaatggaaaaagtccagagaatcgtgttttctttgaagcaaaagcctttcatgcattgaggaacgtatataagaaagcaggattaaaccttgaatggcaaagggactcacaaaacccagaaaaactagataatattacatatgcactgacagtttttaaagaagataaagaagcaaaacaatggttaatagaaaaaggagtcgaagcatcagtaattgaggcagtcctgaacgagagcttcagcgaatttgtaagactatctatcaaagcattacggaagataataccccatatggaaattggacatcgctacgacgaagcagtaaaattagccgggtattcacatcacagccatctaccacaaccttcaaaaacaccttacataccaaggttttcaaaacagagtatagcaaatcctgtcgtctcaagagccttaaaccaagcacgcaagctagtaaatgcaatagtacgagaatatggccctcccgatgcagtacatatagaactagcacgtgacctgaacaaacctttcgatgaacgcaggaaaatagaaaaagatcaagaaaaataccaaaaagataaagcaagagatatcgaaacattccaggaaaattttggtttcacacctaaaggactacaactcactaaatggagactatatagagaacaatcaggcaaatgtgcatactcacttaaaccattagacataaacagattatttgaggacggatatgtcgaaatagatcatgcacttccctattcaagatcatttaacgatggtatgaataataaagtcctgacactcactactgaaaacagaaataaaggcaatcaaacaccgtacgaatacctagatggtgcaagtaacagtgcccaatggagaaactttgtagcttgggtaaactctaacaaatcttatagggcatcgaaacaaagaaatctactccgaaaagattttgctgcacaagccgctacagagttccgagaaaggcacctaacagatacaaggtatatcgcccgggagttcaaacgtatggtagaaactcacctaaaacttaacaaacctaaccaaagatgcgtagtcgtctccggacaactcacggcttatttaagagcaagatggggtttaattaaagtaagagaaaacggagatctacaccacgcattggacgcagcagtagtagcagcatgctcacatgcaatggtaaaaagattagcagactatagtagaaggggcgaattgcaatacgctcgaggccatcactttgatccagaaacaggagaaataatagatattaatgcattgagaaaactcgacgaccactttccacagccatggactgatttccgacgtgaactattggcatggctatcaccagaccctgcgcaacagctaaagaatctagcgtattatacagacgaacgattaaaacaagtaaaaccaataagagtatcaagagcaccgactcgacgcggattaggtgcagcccatcaagaaacaataaggagcgcaaaatatctaggagaaaaccgttccacagtcaaaactcccctagaaaaactaaaacttaaagacataccaaatatagtaggatatgaagatcccagaaatcaccaacttatccaagcaatcagccaaagattaacagaacacggagatgacggaaagaaggctttcaaagaacccttatacaaaccaggaaataataaaagtacagcaccagtagtacgatcagtaaaactctttacagtgcagaaaagtggaatcccagtaagaggaggaatagcgaataacggaaacatggttcgtgtcgatattttcacaaagaaagaaagatactttgctgtcccagtatacgtatccgacgcagccagaaacgaattaccaaacaaagccgtcgccagaggcaaagatggatggatagacatcgatgacagcttttcattcctattctcattatacccaaatgattgggtatcagtcgtagtaaaaccacatgaagcaccctgcgaaggatactatgccggactagacatatcaactggagctatccatatatgggcgcacgaccgaaaccgaagcgtaggtaaaaatggactcatgcgaagcataggaataaaaacagctcactccgtagaaaaataccacgtcgatctccttggaaacttatacagggtggtacacgaaactagaaaacccctaagagccggaaaatga

SEQ ID NO: 4999 - RNA, 3207 nt, synthetic construct
  misc_feature 1..3207: note = Cas9 variant
  source 1..3207: mol_type = other RNA
atgcaatacgtattaggactagatatcggaatagcctcttgtggatgggccgtaataaaccaagaaaaagaacgaatcgaagacttaggagtaagaatattcgataaagcagagaatccgaaagatggcaaatctatggcaaccccacgacgcgacgcaagatccacacgaagaacattaagaagaaaaaaacatagaatgcaaaggataaaaataatcttagtcaaacaaggcttactatctaaaacagaacttgaccatctatatgaatctgccactgaagtagacgtatggaatctaagattagatgctcttgaaagaaaattaaacccaaaagaatttacgcgcgtattaatacaccttgcaaagagaagaggatttaaaagcaatagaaaggaaactacattatcagaaaatggccaaatcttagaaagcataagcgaaaaccaacagattatgggacagaaaaactatcgcaccgtaggagaaatgatattacaagataaaaaattcgaaagccataaaagaaataaagacggaacatacataggaacagtaacaagacagcaattacaagatgaaatacagatgatattcaacgcccaaagactctacaagaacaattacgccacagccgaattcgaaaactcatatttggaaatatgggccagtcaaagaccatacgcaagtaaagaccaaatagaaaaaatgattgggtactgcacattagaacaaaaagagaaacgagcacccaaggcgagctggagtttccagtatttcgtagctttacaaacaattaacaatctaagactaataagtaaagaccgtatagaagaactttcattcgaggaaaaaaaacaaataatgaacttagctttagaaaagtctatcgtaaaatatatagacataaggaaattattatcggtcccaaacgaatttcagttcaactctttatcttattcggccgacacagtagacataacagtcgaaagtagaaaatgtattgaactaaaggaataccacagtataaacaaagtatacaagcaaatctatgaaaaaaacgcgctaaatttgcttccgaaagactatgatacaatagcttacggactaaccatatttaaagatgacaaagacatactcgaatacttgcaaaacaaatatgtaaatgctaaagggaaaccaatctcaaacttcgcaaacaagacatacgatgatacgtttatacaagcattattaaacctaaatttcacaaaaatgggtcacttaagcttcaaagcactcaaaaatataataccatttttagaagaaggcttaagctatgacaaagcatgtgagaaagcaggatacaacttcaaaggcacatcttacacagaaaaaacaaaatatctaccagttataccccaaaacaccaaccccgtcgtacatcgagccctaagccagacaagaaaagtaatcaatgctataataaaaaaatatggaagtcccaacgcaatacacatagaaaccgcacgcgaattgagtaagacattccaagaacgaaaagaaatagactcaatgtatcaagacaatagcaaaaaaaatgaacacgcaatatgtaaactaaaagaacttggaaacataaatccttcaggaataaatatagtcaaatttaaactttggaacgaacaagatggtcgctgcatgtactcaggaaaatacatagaaccacacagattattcgaagaaggttacaccgaagtagaccacatattaccttactcgcgctcattagacgattcttacaataataaaacacttaccctcggaacagaaaatcaaagaaaaggtaacaaaaccccatacgaatacatgggaaatacctcaatatggaacgatttcgaaacgagggtccaatcaaataaaaaaataaccaaaaaaaagcaacaaaaactactattacaacatttttcctacgccagagaacaagagtttatcgaacgaaacttgaatgacacaagatacgcaaccatctatctctcgtcattaatccagcaacacttaatcttcagtgaatcttcaagaaagaaaaaagtacatacagtttcgggaattattaccagccacttgcgaagtagatggggctttaacaaagacagaaaagaaggccacattcatcacgcactagatgcagtaatagtagctgtaacatcagaccatatgatacaacgagtaacaaaatattataaactaaaagagctcaatcgaaatcttcaggcaaaacgcatgccgtttcccgaaccatgggaaggattccgcctagaacttgaagctagaatatccccaaacacacaacaatacctaaaggggttcagatttaaaaactacgcagacgtaaatctaagcgaaattaaaccaatcttcgtttcaagaatgcccaaaagaagcataacaggggaattacaccaagaaacgataagaaaatttataggatataacgaaaagggaaaagtactaacggctatcaaaactaaactcgaagatataccattcgacgcaaacggagactttcccatgtacggcaaggaaacagatctgtatacatacaacgcaataaaagaacgctttctctctcacaaaaaggataaaagaaaatcttttcaggaacccctctataaaccaaccaagagcggaggcataggaccattaataaaaagcatcaaaattattgacacaagaacaatagtcaaccctgtaaaccaaggcaaaggggtcgtatataattccaaaatagcccgcaccgacgtattcaaaaaagatgaaaaatattacctaatcccgatctataccatagaccttatgaaaaatatccttccacaaaaagctataacagctggtaaaggttatgaagattggacaaccatagacccatcattcacctttctattcagtttatttccaaatgatcttatacaaatagtccccagcaaaaacaagacgataaaagcacgaactacagtttcaaaaaaagaagtactactcccatccctaacaggatacttcaaaggtgtacattcaggaaccgcaggaataaccgtagagacacacgacgggagcgtaatcgccaacgttgggtcaaaacaattactattgttcgaaaaataccaagttgacgtcctaggacactacacaaaaataaaggaagaaaaacgaataggaatggcaatatga

SEQ ID NO: 5000 - RNA, 3210 nt, synthetic construct
  misc_feature 1..3210: note = Cas9 variant
  source 1..3210: mol_type = other RNA
atgaagaaacaaccgcaaagatatatcttaggactggatctaggaatcgcaagtgttggatgggctctcatattagtggacggagcagaaaacccagtggggttattagattgtggcgtgagaacattcgaacgtgctgaagtaccaaaaacaggcgactccctagccctagcacgaagacaggcaagaagcgtaagacgattaatacgaagacgagcacatcggctattgagactcagaagactattaaaaagagaaggaatactatcagcagcagacttcaattcagatggactacctaatctgccaattgacgcatggcaactaagagtagccggcctagaaagaaaattaacaaaccaagaatgggccgctgtactactccacctagtcaaacacagaggatatttatctcaaagaaaatcagaaactcaaactgaaaataaagaactaggaagattactagcaggagtagctgaaaattctaagctactttcagaaagctctgaacaataccgcacaccagctgaattggctgtaaaattatttgcagaacaatcaggcagattacgaaacaagggaggcgattatacacatacatttaacagattagatctacagaaagaattgcacctattatttgaaagacaatgtgcattaggtaacccattcgcatccgcagaattacaaagtaaagtagatgaactactaatgacacagcgtagtgccttacaaggagaagcagtattaaaaatgctaggaaaatgcacattcgaaccctcagaatacaaagcagccaaaaatacttattcagcagaacgatttatatggcttacgaaactaaataatctacggatattatacaatggagaagacagagcacttgatgaaggagagcgcaaacaattattagatgaaccctacaagaaagcgaaacttacatacaagcaagtaaggtccatattaaacctgccggaaagtgcagtatttaaaggcttacgatatggaaaagattctgacggtttaaaagctgaaaatggagcattaatggaaatgaaagcatatcataaaataagaacagtgttagaaaaagcaggtttaaaaggagaatgggaaaatagaattagaaacccagaaatcctcgatcaaattggaactgccttttcagtctacaaaacagacgaagacataaaagccgaattagcagctcttaggctgcctgaaaatgtactcgatgcgctcctagctggtctaaactttgataaatttatacaactaagtctaaaagcattatcaaatatattacctttaatggaaagaggtataagatatgatgaagcgtgtaaggaagtgtacggagatcatcgggcattagccgaatcaaagaaccaaatgctattaccgcaaatacccgcaaacgaaattagaaatccagtggtattaagaacgctgacacaggccagaaaagtgatcaatgctatcataagaagatacggtagtccccaaagagtacatatcgaaacagcccgagaattaggaaaatcatttaaagatagaaaagaaatagagaaaaggcaggaagaaaacagaaaagaacgagaaagagcagccgaacatttcaaagaactattccccagatttacaggcgaaccaaagtctggagatatacttaaactgagactgtatcaacaacaacaaggcaaatgtctgtactcaggaatacctatagacttaggaaggttaaacgaaaagggatacgtagaaatcgaccatgcactaccctttagtagaacatgggacgattcatttaacaataaggttctagtattaggatcagaaaaccagaaaaagaggaatcaaacaccctatgaatatctagatggagcacgggattcccaaagatggagagaatttcaagctagggtacaaggatgtaggtttccatacgcaaagaaacaacgaatacaaaccgcaaaactagatagcaaaacagaacaaggatttttagaacgaaaccttaatgatacaaggtacatagcgagattcctatgcggattcattgaaaagagcttacacctacaaggtgccggaaaaaggagagtatttgcatcaaacggacaaataaccgctctactcagaggtttatggggcttaaagaaagttcgagaagacaatgatagacatcacgcacttgatgcaatagtagtagcctgcagtacagtgagtatgcagcagaaaattacgaaagctatgcaaaggagggagaccctagagacaatcaacacagaaacaggagaagttaaaacacgaatacctcaaccttgggatttcttcagacaagaagtaatgattagagtattcagcgatgctccacgagaagaactagcagagaaactcaactctagacccgaagcactacatgattttgttagccccctatttgtcagcagagcaccaaacaggaaaatgacaggacaaggtcacttagaaacagtgaaatcagccaaaagacttagtgaaaatatatcagtcgtaaagaaaccactgacagctctcaaattaaaagacatagaaaatatagtaggatacccagatcgagaacctgcattatatagagcattacaagaaagattacaagcctataaagacgatccagcaaaggcatttgcagaaccgttctataaaccagcaaaagacggcgggcagggctcactcgtaaaggcagtcagaataatagaaaacacaaaacatggccttaaagtgagaaacgggattaccgacaccaacggagacatggtacgtgcagatgtataccagaaagccgacaagaaagggaaaagacaatattttatagtcccagtttacgcatggcaggtagagaaaaacgaactcccaacagtagactgtaaaggctacgaaatcgatgacacttacgaattttgtttctctttatataaatatgacattatagaaatccaaaatcccgacaatatgtcaaaagaattaagggtctattacattaactgtgacagtagtgacggccgattctggttagcacaccacgataaaagtgcaaaagaacaacaattcagaataagcactcaaaaccaacctataataaagaaatatcaagtggatcccttaggaaaagaaataagattatgtaaagccgagaaaagaacagaactaaacggaaagaagaagaaatga

SEQ ID NO: 5001 - RNA, 3210 nt, synthetic construct
  misc_feature 1..3210: note = Cas9 variant
  source 1..3210: mol_type = other RNA
atgaactacgatattggactacgcatcggaattacatcttgtggatggagcataataaataaagatttagaaagaattgaagacttaggagtaagagtcttcgaaaaagccgaaaaccccgatggaacagcctcagctgcaccaagaagagaagctagaaaatctcgaagaaaacatagacgaaaaaaacatagaatagaaagaattaaaagactaatagtgcaacatgacctactatctaaaaaagaattggattcattatacttaagcccatttaacatagatgtatggaatctcagagttgaggcactagaaagaaaattagacaacagagaattcgcacgcgtactaatacatttagtacaaagaagaggattccaaactataagaaaatcagtcgaaattcaagaagaaggaaaactacttgaaaatgtaagcgaaaatgaacgaattatgaaagtgaatggatataaaacagtaggcgaaatgtttagcaaacacgaaaaatttacacaccataaaaggaataaagacggatcatacacaagtgtagtcactagatccctactactaaaagagataaagacaattttcaactcacaacgcatattaggtaacgtattttcgacccaaaaattagaatcagactacttatatatatggggatcgcaacgtccaaccttaacatacgaacaattaatgtccatggtcggaaattgtatctacgaaaaaaaagaaaaaagagcaccaaaaacaagttgggcttttcaatatttctcattattacaaaaaataaacaaattgaaagtatccgacgacaacacactaagaaaattatcaaaagaagaaagagacatagtaattgaattagccttcaaaaaaaagaacgtaagcttcgtagacataagaaaggctctgaaattaaacgacaatacgaaattcaaccatctaacatactctcatgtagttgaaactaaaaaagttgaaaaagcaacatttatagaattaaaaggataccatctgataaaaaaacaattaaaagacagaaacgtagaactaacccaagaactacaaccaaaagactacgacgccatagccgcagcatcgacattcttcaaaaatgacatagaattcagggactacctaagaaatcaatatctggattcaaatggaaaacgtaaaagtaatatagccaacaaagtattcgaagataaagttatagcggcagtatttgaattaaacttctccaaggtgtgccacctatcatttaaatcactatacaagctgatcccacatctagaaaaaggattggactacaaagaggcaattttgtgcgccggctataatttcagagatgaaaataaacgagataaaaagctattcctaccggtaatccaacaagaaaccaacccagtagtgcatagagcactcacacaagcccgcaaagtaataaacgcaataataagagaatatggcagtcccaatactatcagattcgtcgttgcaaacgatctagccaaaacatacaaacagcgaaaagagctcgaatctactttaaaaaaaaatagagcagaaaatgaaaaaatcaaaacaaaactgttatccatgggaatcataaatcctacaggcatggacatcgtaaaatacaaactctggtatgagcaaagcggaatatgcttgtacaccggaagacaaatggaactcagctctcttttcaaaccaggatattcaatagtaaaccacataattccttataacagatcatttgatgacacctaccacaacagagttctcacactaacagaaacaaaatacgaaaaaggtaacaagatacccttcgaatacttcggagcagaagaaacttgttggaatgaatatgaaaaaagggtatctacatcaaaaaaaatacacgataaaaaaagagaaaagcttttaatacggaactttgacatcgaatacgagaatgaaatgatatccaataatgtattcgacactcactacataggttcatactttgaaaaatacattgacgaacacctacaattcaaaaaaagcacaaaaaaacaaaaagtgttcagtatacacggtaacatggtagcacacctccattctcgatggggttttaataaaaatagtcgtgaaatatatttaaatcacgcagtagacgccgcaatagtagctgtacttacagatcaacttataaggaacattgccgattactacagacgcgataatatactagaacaaaaaggaagcctaaaatttccagaaccatggaaatcatttagcatagagctggaagcaagaatttcccctcaagtaagagatctcataaaaaaactaaatttagattcctatttagacgtcgatatactgcacataaagccagtatttatcagcaaaaaacctcgtagaaaggtaaatggagaagcccacaaaagcaccatacgtagtctaatcggaataaatgaaataggaaaaacagttacatgcataaaaactagactagaagatatacccttcgacgaaaacggtgattttccaatgtatggcaaagatacagacaaatacacatatacagcgatcaaagaacgctacttagagtttaacaaagacaaagaaaaagcattttccaccccattatacaaacttaagagaaatggagaaccgggaaaccaaatcaaatcagtaaaaattatagacacaagaaacatagtcaataaagtaaatcaaggcaaaggaatagcctacaactcaaatatcattagagtagacgtattctcacgagatcaaaaatattacgtagtgccaatatatttgcgagacttcataaaaggttccttaccgaacaaaattatcactgccgcgaaaggatttatgcaatggcccgaaacagacaacagttacacattcctgttcagtatcttccccaacgatctcataaaagtagtacctaaagaagggaaattcattaaagccaaaaacgagaataaagaaaacattaaccttacggaaatactcggctatttcaaaggattagactcatcaacaggagcattcacactggaatcacatgacggtagcttactagcaagaggaattggaaccaaaaacttactattaatagaaaaataccaggtcgatgttctaggcagatacaataaagtcggcaatgaagaaagacaagatataaaaatacaacaaaactga

SEQ ID NO: 5002 - RNA, 3210 nt, synthetic construct
  misc_feature 1..3210: note = Cas9 variant
  source 1..3210: mol_type = other RNA
atgaactacgatattggattaagaataggaataacaagttgtggatggagcatcataaataaagacctcgaacgaattgaagacttaggagtaagagtatttgaaaaggcagaaaatccagacggaacagcatctgcagcacctagaagagaagcaaggaaaagcagacgaaaacacagaagaaaaaaacatcgcattgaacggataaaacgattaatagtacaacacgacttactttcaaaaaaagagttagactcattatatctaagcccattcaatattgacgtctggaacttacaagttgaagcgcttgaaagaaaacttgacaaccgtgaattcgctagagtacttatacatctagtccaacgcagaggatttcaaacaatacgaaaatctgtagaaatacaagaagagggaaaattattagaaaacgtaagtgaaaacgaaagaataatgaaagtaaacggatataaaaccgtcggtgaaatgttttccaagcacgagaaattcacacaccataaacgaaataaagatggaagctatacaagcgttgtaacgcgatcactactactcaaagaaattaagaccattttcaactcacaaagaatactcggaaacgtattttcgacacaaaaactcgaatccgattatctatacatatggggaagtcaacgccccactttaacctatgaacaattaatgtcaatggttggcaactgcatctacgaaaaaaaagaaaaacgggccccaaaaacatcatgggcatttcaatatttctcacttctacaaaagataaacaaactaaaggtaagcgacgacaacacactaagaaaactaagcaaagaagaaagagacatagtcatcgaactagcatttaaaaaaaaaaatgtatccttcgtagatattcgaaaagcactaaaattaaacgataacacaaaatttaatcacctaacttacagtcatgtggtagaaaccaaaaaagtcgaaaaagcaacattcatagaactaaaaggatatcatctcataaaaaaacaactcaaagatcgaaacgtcgaattaacacaagaattacaacctaaagattatgatgcaatcgcggcagcttcaacattctttaaaaacgacattgaatttcgcgattatcttcgcaatcaatatctcgactcaaatggtaaacgaaaatcaaatatagccaataaagttttcgaagataaagtaatagcagcagtattcgaacttaacttcagtaaggtatgtcacttatcatttaaaagcctatataagctaataccccatctcgaaaaaggactcgattacaaagaagcaatattatgtgctggctacaacttcagagatgaaaataaaagagacaagaaacttttcctccccgtcatacaacaagaaacaaatccagttgtacatagagcattaacccaagcaagaaaagtaataaacgcgattataagagaatacggaagcccgaatacgataaggttcgtagtagcaaacgacttagctaaaacgtataaacaacgaaaagaattagaaagcaccctaaaaaaaaacagagcagagaacgaaaaaataaaaacaaagctgctatcaatgggaataataaatcctacaggtatggacatagtaaaatataaactatggtacgaacaatcaggaatatgcttatacactgggaggcaaatggaattatcatcactattcaaacctggatactcaatagtcaaccacatcataccttataaccggtcattcgacgatacatatcacaatagggtactaacattaacagagactaaatatgaaaaaggcaacaaaatacccttcgaatactttggcgctgaagaaacatgctggaacgaatacgaaaaaagagtatccacttcaaaaaaaatacatgataaaaaaagagaaaaattattaatacgcaatttcgatattgaatatgaaaacgaaatgatcagtaataatgttttcgatactcactacataggaagctactttgaaaaatatatagatgagcacttgcaatttaaaaaatcaaccaaaaaacaaaaggtattctccatccacggtaacatggtcgcccatctacattcgcgatggggattcaacaaaaattcgcgagaaatctaccttaatcatgccgttgatgccgcaatcgtagcagtattaactgatcagctaataagaaacattgccgattattacagacgagataacattcttgaacaaaaaggttcactaaaattcccagaaccttggaaatccttctcaatcgaattagaagccagaataagcccacaagtccgagatctcataaaaaagctgaacctagactcatatttagatgtagatatactacacataaaaccggtattcatatctaaaaaacccagaagaaaagtaaacggggaagcacacaaatcaacgataagaagcttaatagggataaacgaaataggcaaaactgtaacttgcataaaaacaagactagaagacataccgtttgatgaaaatggtgactttcccatgtacggaaaagacaccgataagtatacctacactgccatcaaagaaagatatctagaatttaataaagataaagaaaaagctttcagtacacctctttataaattaaaaaggaacggagaacccgggaaccaaataaaaagcgtaaaaataatagataccaggaacatagtaaataaagtaaaccaaggcaaaggaattgcatacaatagtaacatcatacgagtagacgtattctctagagatcaaaaatactacgtagtaccaatatacttacgcgactttattaaagggtcactacccaataaaattataaccgcggcaaaaggattcatgcaatggccagaaacagacaactcttatacgttcttattttctatttttcctaatgacctaataaaagtcgtacccaaagaaggtaaatttataaaagctaaaaatgaaaacaaagaaaacataaacctcacagaaatccttgggtacttcaaagggctcgacagttctacaggagctttcacactagaaagccacgacggaagcctattagctagagggataggcaccaaaaaccttttgcttatagaaaaataccaagtagatgtactaggccgatacaataaagtaggaaacgaagaacgccaagacataaagatacaacaaaactga

SEQ ID NO: 5003 - RNA, 3213 nt, synthetic construct
  misc_feature 1..3213: note = Cas9 variant
  source 1..3213: mol_type = other RNA
atggctaccagattaggactagacataggaacaaatagtataggctggtgtttatatgatggtgactccatacgcgacataggagtaagaatttttctagatggacgggagccttcaaaacttacagttagtgggagtggtacacccttggcagtcaaaaggagagacgcgagaggagcacgccgaagaagagacaggtatataggaagacgatccgcaatgctaagagaactcagaaaacacggcttgttaccagccgatccaaaacaggccaaagtactagaaacacaagacccttatgcactacgagttagagcgcttgatgagaaattagaaccacaccaaataggaagggccttattccatctgaatcaaagaagaggcttcaagtcaaatagaaaagcagaaagagcgtccaaagccggtgaagatggtaaaatagcaacagcgacaaaattgttagatgaagaaatgcaaagattaggagccagaacacttggagaatttctcgtaaaacgagatagtgaatttgacggagaagcaggaaaacgtgtaagaatgagagcagactcgaaggcttatgatttttatcctgatagacgacatgttctagatgaatttagagcaatatggaatgcacaaaaagtctggcatcccgaattattgacagaacaagcatggaatgacatctttcgtgtaatagaatatcagagagaattaaaaccacaagtagtggggcattgtacatttgctggaataaacggtgtaccagcagacgaaaaacgacttcctaaagcacatcccctattccaacagaggagactctatgaagaagttaatcaattaaaagttgtagcgcccggagaagctgggcgtcctctaactagagacgaacgagatgccctaatacttaaattacaagataagaaaagtgttagctttgagacacttggaaaaactctaaaattaaaagatggtgaacgatttaacaaagaaagcgagaatagaaaagcactagacggagatgaagtaagagcggcgctatcaggaaagaaattattcggaacaagatggttccatttctctgcagaggaacaatggatgataatagagaggctcctagaagaagaagactcagaaacattattaacatggttaaaaataggttatagattagatgatgaagcagcgttagctgtggcaaatgcaaaattaccagaagggcatggaagatttggattatcagctacaaccgctctacttaaagaattgaaagcagatgtgtgtacatatgcagaagctgctaaaagagcaggatttcatcacagtgacttcagaacaggagaagtatttgatcaattaccatactacggagaaatactagctagagaaatagcacctggaaaaccagaatacggagatgaaaacgagcgaagattcggcaaaataacaaaccctacagttcacataggacttaaccaattaactaagctagtaaatgctataattagactacatggaaaaccagactatatttttgttgaattggcaagagaattaaaattgaacgaaaaggagaaaatagcatataataggcaacttaaagaaaatacagatgctgctcgagataggggagcgaagctaggtacaatgggagttagagacacgggtagaaatagactcattcttaggttgtggacagaattaaatccaggtgatgcattaaacagaagatgtccattctgtggagaacaaatatcacaacgaatgattcagaatggagaagtggaaatagaacacataataccctatagccaatgctttgatgacggaataggtaacaaagtactctcacatgtacgctgtaatcgccaaaaaggagaccaaactccttgggaacggtggggacacgacccagatagatggagtataatacaggaacaagttgcacatctacataggagcaaacaatggcgattcggcccagatgcaagagatagatatgccgcagaagaagattcattcctaccgagacaactcatagacacacaatatttaaccagaatagctgctaagtatttagcctgtctttatccggaacgcggcgaaagacacgtatttgcagtacacggcggtatgacagcaatgctacgtagactatgggatcttaattcaatactactagaccataattgggtagaaaacctgaactccaacgcacccaaaaacagactagatcatcgacatcatgcaatcgatgctgctgttgtaggtataatgacgcctggactaattgctgaaattgcaaaagcagccgcccgagctgaaaagcagaacttagatcgactatttgaagaactacctatgccttgggcacaacacccaaacgacagaagattcagagatgaactaagagagaaaatattagcagctacagtgagccacaaagccgaccatggcagacaaggtaaaccggaaagaggcagagatatcacagcaggcaaattacacaacgatactgcttacgggttcactggcttaacgtcagacactggacttccagttgtagtacaccgagttccattaacatcccttacaccaaaagatatagcagacccagataggataccggatactactttgcgaggatcattatggcaagccacacgagacctatcaggaaaggaatttgaaaaagcattacttgattttagtagaactcatgcacagttcaaaggtatacgtagagtgcgagttagagaaggcttaacattaataccaataagaaaccacgcaggaaaaccgtacaaaggatatctcggtgattccaatgcgcgatataatgtatggcaaatgcctgacggaagatgggtgcatcaagtgatatcaacttttgatttacatcaaccaggatttatagaacaaaggccccacccagccgctaagaaagtgcttagtttaagacaaaatgacttaatagctatagaaagagatggagcattacgacagataatgagagtacaaaaatatggtcaaaatggacaaatatttctgatagaacacaatgaagcaggaaatatggcagaaaggaacaaaaatacagacgatccttttaaattttacggccccggggcatcagcattaagaaatatgaaagcccgacaagtaaggatcgatgaacttgggcgaatattcgacccaggtcccagatga

SEQ ID NO: 5004 - RNA, 3213 nt, synthetic construct
  misc_feature 1..3213: note = Cas9 variant
  source 1..3213: mol_type = other RNA
atggcaaaagattttgaatatatattaggactagatctcggagaaacaagtataggttggtcagtcgtacgactaaatgaaggagtcccagaacatctcgagagactaggcgtacgtatatgtagcgatggaagggacgcgcagtcccacgagccactgtcagttgcaagacgaatagccaggggcctaagaagacgacgggataggtatatacataggagaataagattaactgacgtacttgttaaatatggactaatgccggaagacataaaagaaagaaagaaactacaagccctaaacccatatcgcttaaggtctgaagctctcgatagaaaactagaaccctatgaattaggtagagtgttattccatataaaccaaagaagaggttttaagagtaatatgaagacagatagaaaagattcagaaagtggagctatgaaacaagcaatacttaaaacaagagcgaagatggaagcgagcggcgcccgtactctaggagagtttttatactttttaaacaaagacaaaacatcaacacaagaatacgtacctgtaagaatgagaagtcacagtgaaaagaataagacggtatacgaaatgtatcctgatagagcgatgtatgaagacgaagtccataaaatcttcgaacaacaagaactatcaccagaagcccaaacagaaatatttaatacgatattctttcagagaccattgaaaccagttgaacttggattttgtgaatttgaagatggagaaagacgagcatatacagcatcagtagtttttcaaaaatttagagcacttcaacaaataaatcaaatatatgtacaagacgattacgagagaagaccattaactaaagaagaaaaagatatactaaaacactttttattagaagatttttcagcattggataaaaatggactactcacatgggctaaagtgcgaactctcctaaaactacagaaaaagaaattcaatttagaatcagaaagaagaaaaggattgaacgcggacgtaacaagttggaaattatcaaacgcagcatgttttggaagggaatggttcagcttttcagacgcgaagaaagaagaaatagtagcactgatcacaggagcagaaaaagaagaagaacttatagcagaattaaaaacaaaatacggattaagcgatgaaagggctaaaaatacagcaaatgtaagtttaccagatggagttgcaagtttaagtgcaaaagcaatgaagaaacttatacctttcttagaagaaggaatgttatatgacgacgcagtgaaacaggcaggatatgtttttagtagcagctttaaaggtgtactacccgaaaaatacgaaacatttattgaaccagaatcaggggaatgtttcgacgaattgccatattacggacaagttctaagaagatatgtattaggaggggttccgtccgaagaaaacaaactatttccagaaaaatattatggaaaaataaacaacccaacagttcatattgttctaaatcaattacgcaaattaataaacagcttagtagctaaatacggacatcctagaaagatagttgtagaaatggcacgagatttaaaactaagcaagaaacaaaaagacgctatagcaaaagaacaagctcttaatgaacgagaaaataaaaggataggagcggaactagagagactagatattagaaataattacgataatagaatgaaatataagttatgggaagacctttcaactgatcccacaaaaagatcatgtcccttttgcggcaaacaaataagccaacaagatatatttagtcctgagtttgaaatagagcatctaatcccattttcgagatcatttatggacggtagaagcaataaagttttatcatgtaggagatgtaacagagaaaaaggaaacaaaacaccattcgaggcctttggaaacgactcgacacggtggaacgccatcatgggtagagtagaatcgttaccagaaaataaacgctggaaatttgcaagtgatgcaatgagtagatttgaaagagatggcgatctactagctaggatgatgacagatacgcaatatatggctagaatagcaagaagatatctatgttgtgcagcaaatccaaatcaagtgtacggaataccaggccaactcacagcaaagttgagagaacattggggattaaattcaatattgagtgatcaaaaggaaaaggaccgtagcgaccatcgtcaccacgcgatagacgccttcgtagtggcatgtacggaccgaggaacattgcaaaagtattcaacggaaaggagagattacgcaaaaccagagatgccatcagaaaaagcaccccacataccatttgcagattttagacttagcgatataaaaagagtgtttgatgagataatagtcagccataaacccgataggggaaatgccagagcagcaatcctaaaagggggtacagtcgcaaaattacatgaggagacatattacggaatgggaggagaaggtagtaagaaaggaacttggaaattaatacaaaggattccagtaagcgaaataaagaaagcgagtgatcttgattgtctgatagaccaaaaaggtacagcgaatcctctaagagtattattagtaggtgcaagtgaaagtgaacaagaacaaataatagctagctactttgccagaagggggacacataaagtaaggacatatagagagaggaataaggatgttattttaccattcaaagataaagatggaaaactatatcgatacgctgtctatggttcaaatgcctatgctgaaatttattgcccagatcgaggtaaaaatgcaggaaaatggcaagtagaaattattccaaattactgtgcacaccaaaaaggatttattccaaaatggcgtcacacagacgcgcatgcaaaattaataatgagattatacagaaatgacatggtcgcatatgaaaaagaaggaaagactgttatcgcccgagtaaagaaaatgggtggaaatggagtaattgtgtttagaaatcatttaatagctaaagaggagggagacagactgtcatggcaagcagtagtatcagggatgcaaagcgcaaacctaagaaaaatatatgtagatgtcctgggccgagtaattgacccaaaaaggccgatgactcaaaatgaaacagacggacaggacaattga

SEQ ID NO: 5005 - RNA, 3213 nt, synthetic construct
  misc_feature 1..3213: note = Cas9 variant
  source 1..3213: mol_type = other RNA
atgtcacactttagattaaaacaattaaattatatactgggacttgacctaggaatagcatctgttggttgggctgttgtggaaatcgatacagaagaaaacccaactcgactaatagatgtaggagtaaggacattcgaacgcgcagaagtacctaaaactggcgattcacttgcagcagctagaaggcaagctcgatcagcaagacgacttataagaagaagaacccataggttactaagggcaagaagactgctaaaaagagaaggtatattacacgctgacgatctaaatgctgaaggcctagttaaagaacttccaaacacaccatggcaattacgagttgacggccttgatagaaaactaatgccaaaagaatgggcagccgttcttcttcacttagtaaaacatcgaggctatttgtcacaaaggaaaaatgaaagcgaaggagccgataaagaattaggaagactattagctggtgttcatgaaaaccaccaagcactacaatcatcagaatatagaacccctgcagaactagcagttaagaaatttcaagcacaaagcggtcacattagaaatcagagaggagactatacacatacatttgacagaaaggatttacaacaagaattacatcaactatttgcagcacaacaaaaatatggaaatccctttgtcagtgatggattaaaacaaggcatcgaaacattgctaatgcaacaaagaccagccctaagtggtgacgcagtacagaaaatgttaggtcgatgcacattcgaaactgaagagttcaaagcagccaaacacacgtattcggccgaaagatttatatggctaactaaactaaacaatctgagaatacaagaaaacgggaatgagaggtgcttaaccgcccaagaacgtggccaaatcattgacttaccgtacaagaaagcaaaacttacatatgcacaagtgagaaaagaactatctttaccagaaaacgccttctttaaaggtctacgctatggcaaagaaaatgcggaaacagctgctttgatggaaatgaaagcgtatcacgccattaggaaagcattagagaaagctggattaaaaacggaatggcaaggactagcctgcaaaccagaacttctagatgcaataggtacagtcttttctctctataaaactgatgaagatataagcacaagattacaaggacaactatcagaagatgttattaatgcacttctcgccggattaaactttgataaattcatacaactttctttaaaagccttgtcaaaaatacttccattaatggaacaaggacaaaggtacgacgaagcccacgcagccctttacgtaagatcaacacctcaacctcaacgcctcttaccacagataacggcagatgaaatatgcaatccggtagtactaagaacgctatcacaagctagaaaagtaataaatgctatcgttagacgatatggatcaccagcaagaatccatatagaaactggccgagaagtgggaaaaagttttaaagataggcaagagatacagaaaagacaagaggataaccacaaagaacgaaaacaagcagcagaaaaattcttagaatatttccctaattttgtaggtcaaccaaaagccaaagacatattaaaactgagattataccaacatcaacacggacaatgtctatatagcgggaaaaccctcgatatatgccgacttaatgagaaaggttacgccgaaatagaccatgcactcccatttagtagaacttgggatgatagtttcaataataaagtgttagttttagctggcgagaaccaaaacaaagggaatcagaccccatatgagtggttaggcggggcatcaaactcaccaaggtggcaagagttcgtagccagagttggcagcagcagattccaccacagcaagaaacaaagaatattattaagacaactcgacgaagaaggcttcaaagaacgaaaccttaacgacaccaggtacgtagctcggtttttatgtaaattcatcgaagaaaacatgctcttactaggacgcggaaaacgacgcgtattcgcatcaaatggacaaataacatcctttcttagatcaagatggggtctcagaaaagtcagagaagaaaatgacagacatcatgcattggacgcagtagtagtagcatgctcaacagtagctatccaacaaagaattacgtacttcgttagacagagagaaatgaatatatttgatggagaattaatagataaagaaacatccgaagtcagtagaccatacttccctcaaccatgggacttctttagacaagaagtaatgatgagagtattcggcaaaccagatggagatccatcattcccggaagcagataccaaagaaacattatgtacactactagaaacgagattatcttcaagaccccaagcagtacatgaatatgtgacaccccttttcgtaagcagggcgcctacccgaaaaatgagcgggcaaggacataaggaaactgtaaaatctgcaaagttattacacgaaggaaaatcagtactacgtgtaccattaacacaattaaaaccaaatttgctagagaaaatggttaatcgagacagggaaccgcaattatatgaagcccttaaagaaagactagcagcatatggtaatgatccagccaaagcatttgcgactgaatttagaaagaaaggtggacaattagtaaaggcggttcgagtagaagatactcagaaaagcggagtattactacataaaggaacaggagtagcagataatgcgacaatggttagagtagatgttttcgaaaaatccggaaaatattatctcgtacctatatactcatggcaagttgctcaaggtatactccctaataaagcagtaatacaaggcaaagatgagaaaaactgggatgaaatggatgaaacatatactttcaaattctcaatgtatccgaacgatctcgtagaaatcaataccggaaaacaaaggttatttggatattatataggactcgatagagcgactggagcaatatctattagggaacacgacttagacaattttaaaggtaaaaatggaatttaccgtgtaggagtaaaaacggccataagttttaagaaataccaaacagatgaactaggaaaagttgttgttccatgccgaccgaagaaaagactaccagttagatga

SEQ ID NO: 5006 - RNA, 3216 nt, synthetic construct
  misc_feature 1..3216: note = Cas9 variant
  source 1..3216: mol_type = other RNA
atgcgactaggcctagacatcggcacaaattcaataggatggtggttataccaaacagacgatggaacaataacagatgtgctggatggaggagtgcgaatatttagtgatggacgtgatccccaaagcaaagaatcactggctgtagatagacgagtagcacgtgctcaaagacgtcgacgagataggtatcttcgtagaaaagcagcgcttatgaaaagaatggctggagcaggcttgatgcctacagatcaagcacatgcaaaaaagttagaaagtctcgatccatacgctcttagagcggaaggtttggattgtgaattaccattaacacatctcggacgcgcactcttccacctaaatcaacgaagaggatttaaatcaaatagaaaaacggatcgaggggataatgagtcgggaaaaataaaagatgctacggctagattagactgggcaatgagagatgcaaaagcaagaacttatggcgaattcctacacactcgtcaacaaaaagcggatgaccctaaaagaatgccaactgttagaacacgcttgactgtagcgcgtagagacaatgcggaaaaagaagaagcaggttacgatttttatccagatagaagacatttatcagaagaattcgatgcattgtgggcggcgcaggcagattatcatgaagcactatcagacgaccttagagatcaaatcaaaactattatatttcaccagcgacctttgaagacacctgaagtaggcttatgcctatttacagacgaacgaaggataccttcagcccacccattaaaccaacgacgaatattattagaaactgttaacgccctccgaatagtagccagaggcgaagcagcaagaagacttacattagaagaaagggatcaaattgttcatgcattagataataaaaaccatacgaaaactttaagtggtatggccatgaaactaaaagcgttaggtaaagtaataagattaaggtcggatcaaacgtttacattagaaaccgccaatagagacgctatagcatgtgatttagtacgcgccagcctatcacatcccgacagaatgggtggagtttggactaccttagatgaaggagcacaatgggaagtagtacaacgaataagggcagtgcaatcagactcagaattcgatgccttggtagtatggttagaacaaaatcacggtctagataatgcacatgcacaagcaacagctaatgcaccactaccagaaggatatggacgaatgggattgatggctacaagaagaatactagccgccctacaaagcgacgtaatgccatattctgatgcagtagcagcatgcggttggtcacatagtggcggacctaccggcgaagtattagaaaaattaccatattatggcaaaatattagacaggcatgttataccaggaacatatgatgaaaataatgaagacgtaaaacgatacggaaggataactaacccaacagtccacataggactcaatcaaataaggcgtctagttaatagaataatatgcatacatggaaaaccagacgaaattgttgtagaattagcgagagatttaaaaaatagcgaagaccaaaagagagaaatacaaaaaataatcaagaagaatacagatgcagctataaagagaggagaaaaattaataaacgaactaggtcaaaaagataccggagcaaacagactagtattacgattatgggaagatttaggacacgacgtaatgacaagaaattgcccttatagtggaaagcgaatatcggcgggcatgttattcgatggttcatgcgatgtcgatcatattctaccatatagccgtactttagacgacggaattgccaataaaacactatgtttgaaagaggcaaacagacaaaaaagtaataacacaccatgggaggtatggggagaaacagagcaatgggacacgatagctgcaaacttaaaaaatttgccagataataaagcttggaggtttgcatctgatgcaatgcaaaggtttgaaggagaaaatgactttagcgccagagctttaaaagacacgcaatacctaagtagaatagcaagagcttaccttgacgctttatatgacggaggagacggcaattcgcacgtatgggttgttccgggaaggctaactgaaatgctaaggagacattggggactgaacggcctagaagcattaacggatagcgatgaaaacacagttaaagcaaaaaataggatggaccatagacatcacgcaatagatgcagcagtagtagcggctactgatagaggattaattcaaagaatatcaaaaattgcaaagcgggatgaacaagcaggtgctgaggaagtagctagatcagtaagcccaccttgggacggttttcgagatgatatagcagcacaactaagtagaataatagtaagtcatcgggcagaccacgggcgaatagacagtcaagcaaaacaacaaggtgaagatgcaacagcaggacaactacacatggataccgcctacggagtagtggacgcgggaagagtagttagtagaaagcctttactatcactgagcgaatccgatataaagaaaataagagatccagatctacaaaggcacctaacaagagtaacaaaaggtttagataaaaaagaatttgaacacgccctaagcgattttgcaaacgcgagaaaattgccagaccagagcgaaaatccttactttggaatgcgtcgagttagattgatcgatgcattacaggattcagcacgagtatcagtaagggacagagacggccatatatacaaggcatacaaggcaggctcaaatcattgctacgaggtatggagactacccgatgggaaaatcaagccatgggctatctccacatttgaagctcaccaaactggaacagaaagtaagcctcatccagcggctaaacgactattaagagttttcaaacgagacatggtcgcaatagaacgtgacggggaaactttaatgtgctatgtacaaaaaatggacattgctaatggactctttctcgtgccacatacagaaggtaatgcagatgcaaggaacagagacaaagatgattcattcaaattcatacaaatgagcgcagtgagcctgataagagcaaagataagacgaatacacgtggacgaaatgggaagattaagagatcaaggcccaccacgatga

SEQ ID NO: 5007 - RNA, 3216 nt, synthetic construct
  misc_feature 1..3216: note = Cas9 variant
  source 1..3216: mol_type = other RNA
atgagatacacgatagggctagacataggaattgcaagcgtaggatgggcagtcataaatgaagataaatcaagaattgaagacctgggcgtaagagttttcaaaaaggcagaagaaccagacggcaaaagtctcaacctagctagaagagaagcaagagggagcagaaggagaatcagaagacgagcaacaagaatgcaaaaagtcaaagaactattagtgaaatacaatttagtatcagaaaaagaactagaaacactttacataatcacagaaacaacaccagatgtatacgaactaagagcaaaaggactagacagactactgagcagacaagaatttgcaagagtgcttactaacattgccaaaagaagagggtataaaagtaatagaaaaattgacgaagaagacaaagaagttggtaaattatcaaaaggaacaatcgaaaacaaaaggatcttacaagaaaaaggatacagaacaataggagaaatgttttacaaagacgaaaaattcgaatacaacaaaagaaataaagcaggagaatataactcaaccgtactccgatcaatgctaatagacgaagtacacactctatttgaaatgcaaagaaaattcaaatcagaatttgcaaatgaagaatttgaaaaagagtatgtagaggtaatgacataccaaaaaccgtacataacacccgaattacttgagaaaatgctaggaaaatgcacgttcgaaaaaggcgaacccagagcacccaaaaactcatacacattcgaaagattcatgctactacaaaaagtgaataatttgaatatatatataaatggcgaaaaagttgaaataccacaagaaaagaagaaagaaatcattgaactggcgtataaacaatcagaaataaaatatacacaactaagaaagaaactagaactgcccatagaggctaggttcgccgatttaaattatcaaatcaaaagaacagaggacgaaagtgaggaggctttagtaaagaaaattgaagacaagaaatttgtaaaactcgaaggctggcacaaaataaggttagcattaaaagaaaacaaagataaatttgagaaaattgagaaaaatcctgagctacaaaacataatagcagatgccctggtaagaaataaaaccgacgaaacaattaaaaactacctagaaaaatcagacatagatgaagaaataattaacgcaatactgaacatcaacttcacgaaatttggccatttaagttacaaagccatgaataaaataataccagaattggaaaaaggcttaacatacgacaaagcctgcgaaaatgtaggatacgaatttaaaggaagaaagaacgaactacaatataaactaccaccggtaactgaattagaagatgaaatattaaatagtgtcgtattaagagcagtgagccaaacacgaaaagtcataaatgcgataatagacaaatacggtagcccaacagccatttatatagaaacagcaagagaactaagcaaaccatatgacgaaagaatgaaaattgagaaaagacaaaaagaaaacgctgcaaacaacgaccaaattaaagaatatatcaaagaaacattcggatttgatcctaaaccctttgacatagtaaaaatgaaattatggagggaacaaaacggtaaatgcgcttactcaagtaaaccaataccagcagagaggttatatgaagaaaacttcgtccaagtagatcacataataccgttttctcgatgtttcgatgatagctaccaaaacaaagttctagtattgactgatgaaaaccagaaaaagaaagaaagaacacccttcgagtattttggggaagacaaagaacggtggcaccaattcgaagagttcgtaaacttaacatataaattcaacacaagaaagaaagaaaacttactaattaaaaatttcaatgaagaaaaatcaaaagaatggatacaaaggaacataaatgacacaaaatacatatcaaaattcatgtacaattacatagccaataacttaaaatttgcagatagtgaatcaaaaagaaaagtttataacataaacggacaagccacaagcatactacgacactactggggactaaagaaagatagagaagaatcagacaaacatcatgcacaagatgccgtcattatagcatgcgcaacaaacaaaaacatcaagaaagtgtccgactattcaagacgaaaattactgtacaaaaacaatgagataatcgacgaggaaacaggagaaataatcgacaagaaatacaacatagacataagcataaaagaaccatggcctaaattcagagaagaagtagaagcaagaatggaggacgcagataataatggacagctctacgcactgatcaacggaaacttcacaaactatgacgatgtggacataacacatataaagccgatcttcacatcgagaatgcctgaaagaaaaataaccggacgtgctcacaaagataccatgcgatcacaaaaattcatacaacagggacaaaactttaccgtggtgaagaaaccactcaaagcaatatcaaaacaagaaatcgaaggtattataaacaatccagactttaaaaatctatacttatcagacaagaaattatacgatgatatatatcagaaaatgaaagaagcagattttaaagcagaaaaagcatttgcaaatgaatacagaaagtatagcaagaacgggaactcacctattgtaagaagtataaaagtagcttccgccggtgctacaggagtgcaactaaagaacggagccattgcggaaaacgcaaatatggtgagagtagacgtttttgaaaaagataataaaaactatttagtaccaatatatgttagcgattttgccaaaaacgaattacccaacaaagcaatctgcgcaaataaagatgaaaaagaatggattgaaatgactgaaaagtataagtttaaattcagtctatatccaaacgacctggtaaaaataaagaggaaaaacgaaaaagagttctatgcctattactgctcaacccatagaggaacgggaaacataaacttattattagtaaacggtgaagcgaggaaagacggtgtaggaattaaaaacacagaaatattcgaaaaatatcaagtcgatgtgttaggaaacataagtaaagtcaataaggagaaaagagaaggagtaaaatga

SEQ ID NO: 5008 - RNA, 3216 nt, synthetic construct
  misc_feature 1..3216: note = Cas9 variant
  source 1..3216: mol_type = other RNA
atggactatagaatcggattagacataggtacaaacagcatagggtggtcgataatagaactgaccaccgttcagagcaaattagatggcaaatatagactaaaggcagtaggcctaatagatgcaggagtaagaatgtttgacagagcagaagttccaaaaactggagcatcattagcactaccgagaagacttgctagaagctcgagaagacgactaactaggagatcggcgagaaagaaagcaatacgcaacttattggtaaaagaagatatactaaatcaaatagaattagatcacctatatcggacgtccgagcttgttgatatatggcaaatacgagtagaaggactcgaaagaagactcggacgacaagaatgggcaagattattaattcaccttggacaaaaacgaggatataggagcactagaaaggccgaagaaggcgcagataccgaaggaagggcagtattgagttcaataaaagaaaaccaagaaaccctaaagcaatatagaacagttggagaaatgtgggccacagatgacaaatttaaaggccgagtaagaaacagtacaaatgaatttatatttaacgtatcaagagataacctagaagaagagataaggtttttgttccaacaacaacgagaactcggttcaatgtatgcgtcaaagctattagaagaatcatatatggaagtctggggacatcaactaccatttgcttccggcgagagcatattaaagaatgtaggaacatgtagtctttatgaaaaagaaaaacgagcagctaaagcaacatatacatttcaatatttcatggcattagataaactaaacaacgtaagaatacttccatcaatgcggacattatctgaagaagaaagaggcttagccctcaaagcaatgtttgaacgagacaaattacctaaaaatcccccaaagttcacttacagccatctacgaaaagcaataaaactagaagaagacgaaacctttcaaaccatatcatacgacgttgagaaaacgctagcgacaaacgagtcagccgtctttgtaaacctggcagcttattatcaaataaagaaagtttgtgatgaacacaatgaaaattatgactatgtagattataacacaataggccacgcattaactgtatataaaacagacgaagacataaataaatacttagcaagcaaaaacaacattgcaaagcgagtatacgctaacgacttcatcgattcagtactcaaacactcatacaccacctttggacacttatcactaaaagcactatcacgaataatacccctaatggaagaaggagaggtatttgcaaaagccaaagaaaaagcagggttcaaggaagaaagctacctcgaaataaagtcaaaacttcttactaatataccagacgcgattaaaaatcctgtcgtaatgcgatctttaacccaggcaagaaaagttatcaatgcaataattaaaagaatgggagagcaaccagcaagcatacaaatcgagcttgcacgagaactaagcaaggatgtaagtgaacgtaaaaagataacgaacgggttcgcagaaaatagaagtagaaaccaattcgccataaaaacattagaagaaaatcacataacaaatatacgaggacaagatattgtaaagtttaaactatggcaagaacaaggagggcgatgtgcatattcactaaagccaataaaactagaagaacttatctcttttcttaagaaagaaagaagatatgaacataatctagacgtagatcatataataccatacagcaaaacatttgacgacagctatactaataaagttttggtttttagcgacgaaaaccgaaagaaaggggatcaaatacctgctgaatacctaggaataggtacaaaaagatgggaaaaatataaagaatttgtaattacgtcaaaattcccggcaagcaaaaagaaacgattgttaaaagaacaattagtagagagagaagaactattcatgaaagaaagacatttaaacgatacacgatacgcaagcagatatttcatgaattttctaagagagaatctacttagaaaagaaacagttctacatgaaacccagtgggtaacagcagtagcgggaagagtaacatcccatatcaggaaacgactaggatttgggaaagatagggaagaaacacacctacaccatgctttggatgctataatagtcgcgtgcaccgacaaatggatgattgattgtgtaaccaattattacaaatccagggaaggaggaagtataaaaagaaaagaaattcggtttccatcaccatggaacggattttggcatgatgtacaaactaaattagcccagctgccacaacctgaagttatcaatgaatccatatcaaaaggtaacccagatgcagtcgactacatgcttgtatctcgtatgcctagaaaaagtataactggcgcagcacacaaggaaactatttcaaaatggggaggatacgacgataaagggaaagcactattagttaagaaagtagcactatcagaactaaaatttaaaaatgacgactttcctatgtataataaagaaactgatcctttattatacgaggcaattaaaaatcgatatgtcgaaagtggaagagacgtgaaaagagcttttgctacacccctatacaaacctagcaaaagcggaaaacgaaatgaagtgaaacgagtaaaagtaatagccgaaaagaaagctatggtcagagaagtcaatggagggatagccgaaaatggtggattagtacgttcagatatattcctgaaagaaaagaaatatgtaatggtacccgtatataccttcgatacgattaaacaacagttaccaaacaaatacgtagtaagcggtcgaggatatgaacaatggcccgaacttactgcagaacacgtattccagttttctgtatacccatacgagctagtacatgtaggaacaaacaaaggagacaattccttctattacttcgcctcattaaatataagctcaaacgtactaaaattcagcgaatgtaataggccaacaaaagactatatagaaataggcctaaattcaataatcctgttagaaaaatacgaaattgacgttttaggaagaataaccggacagtcaaagaaaggaataagacaaagttttaaaaacaataaaagccaaatgaaagaatga

SEQ ID NO: 5009 - RNA, 3219 nt, synthetic construct
  misc_feature 1..3219: note = Cas9 variant
  source 1..3219: mol_type = other RNA
atgcgactgggtctggacataggaacaaattcagtaggatggtggttatataaaaccgacggggaagctgccagcgcaagaatagttgaggttatagacggaggcgtaagaatatttagcgacggtcgcgatccaaaaagtaagacatctttagcagtagaccgaagagtagctagggcagccagaagaagaagagatcgatacctacgcagacgagcaagtctcatgaaacttctagcacggacgggactcatgcctgcagacccagtagaagcaaagaaacttgaaagactagacccgtatgagttgaggagtacaggcttggatgatgcgttaccactaactcatttcgggagagctttgtttcatcttaaccaaaggagaggttttaaatctaatagaaaaacagatagaggggataatgaaaatggtaaaatacgagaggcaactgctagactggaccttgaaatgatgacatcgggagcaaggtcgtacggtgaatttctacatatgcgacgacaaagagcttcagaccctcgacatgtaccttcagttaggacaagattatcagttgccgcacgtggaggaccagacgcgaaagcagaggcaggatacgatttctacccagatagacatcatctagaagaagaatttcatgcactttgggcagcacaagctacacatcatcaagccctaacagacgacttacgagatcttgtttttgagaaaatattttatcaaagaccattaaaagaacccaaaatagggttatgtctattcacagcagaagaaagaatagcaaaagcacatccgttaacacaaagaagggtactattcgaaactataaatcaactaagagtgactgcagatgggcggagtacaagaccattaacactcgaggaacgtgatacattagtacacgcattggataataagaaaccaacaaaaagtatgacttcaatgaatatgacactgaaggctttagcaaaattgttaaaactaagagatggagaaagattcactttagagacaggtgttagagaaaatatatcgtgcgatccagtgagagcatgtatggcacacccagcaaggtttggcccacaatggagcagcttagattgggaagctcaatgggacgttatatccagagttcgtcaagttcaaagcgaaggagagttcatagaacttactgactggttaatacaaggacacggattagatgctgatcacgctaaagctgtaggaaatgcaccattaccagaaggctacgctagactaggattctctgcaacagaacgcattttagatcaattaaaagcagaagtttgcacatattccgacgcagtagcaaaatgtggatggcatcattcagatcaacgcacaggggcgtgtctagaagtattaccatactatggagaagtgttagatcgccatgtaattcccggtacttatgatgctacagatgacgaaataactaggtatgggcgaataacaaacccaacagtgcatataggtctgaatcaattacgaagattggtcaacaaaatcatagaagtacatggaaaaccagaccaaattgtagtagaattagcacgagaactcaaacaatcagagccacaaaagaaagatgctatgaaaaggttaagaaacactactgcagatgcaattagaaggtcggaacaactagaacaactaggccaaccaaacactggacataataggatgctcctaagattatgggaagatttgggaccagcaataggaccaagatgttgcccgtataccggaaaaacaataagcgtaactatggtatttgacggaagttgtgatgttgaccatatattacctttttctcgaactttagatgactcatttgcaaatcgaacgctatgtcttaaagaagcaaatagagagaaatcggatagaacaccttgggaggcatggggtggaactgatcaatgggacgatattgccgctaatctaaagaatctacccgaaaagaaaaggaaaagattcggacccgacgcaatggagtggtttgaaggagaaaacgattttctagacagagctttagttgatacccaatatttagctaaaatatcaagaatgtacctagatacactttttacaaaaggaggtcatgtctgggttgtgccagggaggatgacagaaatgttaagaaggcattgggggttaaacgcactattgaatgataaagaccgaggagcagtcaaagccaaaaacagaacagatcatagacatcatgcaatagatgcagcagtcgtagcagcaacggactaccgactcatgcaaaagataagtagagcagccggacaaggagaaaatgcaggacaaagcgcagaattaatcgcgcgagatacggacgctccatgggaacactttagggcagacattgcatcacaacttgagaaaataatcgtaagccacagggctgaccatggaagaatagacgtagaagggcgaaaaacgggaagagattctacagctgggagattacacaatgatacagcatatggtgttattgacgacttaacagtagcttcaagaacaccgcttatgagtctcaaaccaagtgatatagcaatcacagaaagagggaaaaatataagagatccgcaattacaaaatgccttatatgttgctactaaagggaaagaaggaaaaatgtttgaacaagccttagtggattttgctagcaaagaagggccataccaagggattagacgagtgaggctagtagaaacactacaaaaggctgctagagtggaaataggaaagaccgaatcaggtcaaccattgaaagcatataagggagattccaatcactgttatgaactatggaaactcccggatggcaaaatagttccacaagtggtgacaacatatgaagcacatgcaggctcagctccaagacctcatccagcagctaaacgaatacttcgagtattcaagaaagatatggtaaaacttacgaaagatggcgaagaaatagtaggatacgtacaatcaatgcatattaaaaacggcctatttgtagctcaacaccttgaagcaaatgctgacgcaagaaatagagataagacagatccctttaagtttctccaaatgggggcaggaacattggtaaaaacaggacttagaagagtcctagtagatgaaataggaagactgagagatccgggtccacccaagctatga

SEQ ID NO: 5010 - RNA, 3225 nt, synthetic construct
  misc_feature 1..3225: note = Cas9 variant
  source 1..3225: mol_type = other RNA
atgcaaactaaaaatttaccatacacactggggcttgacataggaatggcaagcgtaggtgctgcattactcctacccgaccaagaaaggatattagccctacatgtaaggacatttgataaagcagaaacggcaaaggaaggagaaagtttaaataaaataagaagggatagtcgtcttacacgaagacgaataaggagacgagcacataggctagtacgattagctagattaatgaaaagagttggactaatagcggacgcaaatcctgaggcatttgcgctcccaggtgtcagtccatggcatttacgagcagacggactagatagactactagaacccaaagaatgggcaggagttttgtaccacttagtcaaacacagaggattccaatctaaccgaaaaagtgaagcaaaggcagacgaaaaagcgggacaaatgttaagcggagttggtagaaatcaagccttattaaaagaagcaggatatagaacagtcggagaattggcagcaagacacgaagatttcaaagaggcaaaaagaaacaaaggaggtagttatagccacacattcgcaagagcagacttaaatgcagagttaaatcttttattcgaaagacagagagcactcgggtctagattggcgagtgcagattttcaagaaaatgttagagatctattaatggctagaagaccaacgttaagtggggcaaatttgcttaaaatggtaggaaaatgcacgtttgaaaaatccgaagaccgagcaccaaaagcgggatacagagcagaaagatttgtatggctaggaaaattaaataatttaaaaattgtgggcagtggagacgcacgtccactgactgacgcagaacacagaattgtcatagacttaccgtttactcaggcaaaattgacatttaaacaagtaagaaaagcattagagctagaaacgcaccaaaggtttaaccttctgagttacagaccagaccctaaaggtaaagacaaagatcctgaagagtcaacattctttgaagcaaagagctttcatacactcaggaaagcgtacgaaggtgcaggcctgaaaaaggaatggcaaagagacgccttagatcccgataggttagatgcgttagcatacgcattaacctgttacaaagatgacactgaaagcagacaatggttagtagcacaaggtataggcacgccaataatagaagccgtattagcagaatcttttgacaaatttattcatttaagtcaaaaagctctaaaagctatattaccgcacatggaagcaggccaacgttatgatgatgctgcaaaatcagctggctacgatcactcgcaaccagacgcaggaaccggtaaacgggcaaccttgccgcctccagataaagacaccatacgaaatccggtcgtatatcgagctttaaatcaagcaagaaagctagtcaacgcaatcgtagcagaatatggaccaccagcagcagtccacatagaactggccagagatttatcaaaaccaatagacgaacggcgagacatagagaaaggtcaaaaagaatttcaagctctaaaagaaaaactcgcagcagcttttgaagaaacttttcaccgaaaaccctcaggcctggatttattgaaatatagactatttagagaacaattagatcaatgtccatactgtcaaaaagcattggtcgtcgacagattattcgaacctggttatgcacaaattgatcatgcattaccatactctagatcattcgatgacggcatgaataacaaagtagttgtacacgtagcgtgcaatcaagataaaggaaatagaaccccttatgaatttctagacggtgcaggagactcagaaagatggcaacgttttgtagcctgggttcaaggaaacaaagcaatacgacaagcaaaaagaaaccgattattaagagtcaatttcggtaccgatgaggcaaaagagttcagcaaaagaaacctctcggatacacgatatatttgtagagaatttaaaagaactatagaaacacaatttgcgtggcattcagacgcagaaggaaatgagaggtgtgtagtactgagtgggcaacttacgagcttactaagagctagatggggcctcataaaagtaagagaagatggtgatttacatcatgcattagatgtagcagtcatagctgcggcgtctcgatcattagtaaagaggatggctgactactcaagaaggaatgaactagaaatggtgcgaaatagatatgtagatcctgcaacaggtgaagtagtagacgtagcagcactgagacaaatagaagaccactttcccaaaccatggcctttattcagagaagaattactagcgcggctggcaccagaaccaaaattacaactgacttgtgtaagcagttatgatgaaggtttgagagagagtataagacctataagggtaagtagagcgccaacacggagaggcttaggagcagcacatcaagaaacaataagaagccttagagatggttcacaatctgcaattaaaactcccttaagagaccttaatttaaaggatctggaaaatatagttggatttgagagagacacagcactaatagatgcgattagaactagattggaagcatttggcggagaaggtaagaaagcctttgatgacaaacagcctccactaagaaaaccaagtaaagatccggacaaagctcccataataagatcagtaaaactcctagtgacacaaaaatctggaataccaatcagaggaggcattgctaataatggagcaatgttaagaagtgatatctttacaaaagcgggtaaattttatgctgtgccaatatacgtagccgatgctgtaaggggagaactaccacatagagcagtcgcgcaagctaaaccagaactagaatggcccatgatggatgaaagttatcagttcttattctcattacatccaaatgactggatgactatccgattaaagaatgaggtcagagagggatactacgcaggtctagatagagcgacgggaaacataagcctatggctacacgacagaaaccagaatgttggtcaaaaaggactactaacaggaaatggaataaaaaccgcactagcagtcgaaaaataccacgttgatttgctaggcaaactacatcgagtccataaagaggaaagacagcctatacacataaaaccaggcaaaaggtga

SEQ ID NO: 5011 - RNA, 3234 nt, synthetic construct
  misc_feature 1..3234: note = Cas9 variant
  source 1..3234: mol_type = other RNA
atgaaatattcaatcggactggatattgggatagcaagcgtcgggtgggctgtaataaacgaagacatcgaaagaattgaagatcttggtgttagaatatttgacgtcgccgaacagccaaaaacaggtgcttccctctcaaccccaagaagattagctagaagtacaagaaaacgactaagaagaagaagacaccgagtagaaagagtgagaaaattcatgatacagaaaggcctacttacccaagtacagatggaacaattatatgattggaaagatggagacctagacatatggctagtaagggtaaatgccttagaaagaaaattgtcagatagagaattcgcacgcatacttgtacacttcgcaaaaaacagaggattccaaagtaatcgtaaatcagaactgcaagaagaagacaatggagctgtattgagcgccgtacaagaaaataaaagactcatggaagaaaaaggataccagaccatatccgaaatgttactatatgacgaaaaatttgaaggaacaaaaagaaacaaaggaggagaatacacacatgtagttgcaagaagcgatttaaaaagagaaatacaattaatattcgaaaaacagcgagcgtacggacacgcatttgcaacaatggaaaatgaagataaattccttcaaatatggtcaagccaaagaccgttcgccactaaagacgatatagcaaaaaaaataggaaattgtacattcgaaccaaaagaaaaaagagcacccaagagtacatacacttttgaaagatttcgtgcactggacaaactaaatagactaagaatactatcaggtacatcaccggcacgttcattgacacaagaagaaagggatttgatactcaattctcttttcagcaaaaaagaagtaaaatataaagaactaagaaaattattaaaattgaacgacgagcaaagatttaatgaaatattctatgaccccaacgaaaaaatagaaaaaaatgaaaacagaacgttcctatcattagaatcccaatataaaatacgcaaaattctacaaaaaatagaaggcaaatcattgaacgacacataccgtccagtcgacttagatacgatcgcttacgcactaacagtattcaaagatgaccaagacatcagagattatttacaaaaccaatatgtagcttctaacggcaaaaaagaattaaatttagcaaatcgaaagtataatgacgaacttatcgaagaactacttcatttatcatttactaaatttggacacctatcactaaaagccttaagaaacatactcccatttatggaacaaggaataccttatcaccaagcgtgtgaaaaagctggctaccaattcaataaaaaagtaaacagagaaaaacagaaactattacctcccgtaccagccaaagatatagtcaatccagtagttattagaagtttatcacaagtaagaaaagtaattaatggtatcattaaaagatatggatcacccagcagcatttacatagaacttgcccgcgaaatgggacgaggttacaaagaacgaaaagacctagaaaaacaatataataaaaatagacaaatgaatgaaggagcaaaaaaacacatcttggaacttagacctgaatttggagaccctagaggccacgatatacttaaatacaagctatggcaagaacaagactgccgatgcgcttactcattcaaatctataccgattaaacagttattcgaaataggttacgctgaagtcgatcatatcataccctactctagaagttttgacgacagtaataataacaaagtcttagtactggcagccgagaatcaaaacaaacaaaaccgaacaccttatgaatggtttggtcacgatgaaacaaaatggcaggaatttacctcacttgtaacaacaatgaaggtaagcaaaaagaaaaagtctttattattaaagaaaaattttgacgaagagcaagcagaagaattcagaagtagacaccttaacgatacacgatatataacaagatacatcaaaacttttatagaggacaacctacaattccgtatagaagagggtaaaaaaacatatgtacacacagttaacggtgcgtacacatcgctgatgaggaaacgctggggatttaataagaacagacaagaaaatgctttacatcatgcattggacgccgtcatagtagcagtatcattgccatttaaacacaaggtaagagcatactttaaaagaagagaagaatacgctcacaaccagctaaaaagagaaggagagttttttccagaaccttggccaggttttatacacgaacttgaaatcagaatgatgcaagactcagaaaacatcaaactagcaatggaatctttgaacttaaaaacatacgatgaaagtttcataaaagagctgaaaccaatctttgtcagtagaatgccaaaaagggcaatgaaaggacagatacatgaagaaacactaaaacgagtacggggacggacggacgatggatacataagaaccgtgaagaaagtcaaactggaccaaatacctttcgacaaaaacggagacttccccatgttcgggaaagagacagacatgaaaacatacgaggcaataaaaagtcggtatctagaatcaggaaaagacaaaaaaaaagccttcaatacacctctctacaaaccagcaaaaaatcccgaaaatgcgcctataataagatccataaaaatagaagagaaagcaaatcgagtggtgatgctagacgaaaaaaccgcagcagacaacgcaagtatagttcgaacagaagtatttagacacaaagagacaggaaactacttccttacccctgtgtatgtagcagatgtactagcaaaaaaagtcccagatcgtctaatcacaacgaaaaaaccctatagtgaatggcgcaaaataacagacgaatatgaattcttattcagcctttaccccaacgaccttatcagagtaaaaatgccaaaagaaaaagaaacaaagactcacacaggagaaaaacatgtatggcaagaaaattttatgtacttcaaaggagtacatagcggaagtgcaggagtaagaatgattgaccatatgaactcatttgaagatgaaattggagtacgcaaattagtcgtattcgaaaaataccaagtagacccgctagggcgaatgaacaaagtacatggcgagaaacgacatggaatctga

SEQ ID NO: 5012 - RNA, 3234 nt, synthetic construct
  misc_feature 1..3234: note = Cas9 variant
  source 1..3234: mol_type = other RNA
atgaaatatagtataggactggacataggcatcgccagtgttggttgggcagtaataaatgaagacatcgaaagaatagaagacttaggagtaagaattttcgacgtcgcggaacaacccaaaactggggcatcactaagtacaccaagaagattagcaagatcaacacgaaaaagactacgaaggagacgacatcgtgtagaaagagtaaggaaatttatgatccaaaaaggccttctaacacaagttcagatggaacaattatatgactggaaagatggagacttagacatttggctggtaagagtgaacgctttagaaagaaaattaagcgaccgagagttcgcgcgaatactcgtccattttgctaaaaatagaggtttccaatcaaatagaaaatcagaattacaagaagaagataatggagcagtattatctgccgtgcaagaaaacaaaagattaatggaagaaaaaggataccaaacgatatcagaaatgttactatatgatgagaaatttgaaggaacaaaacgaaacaaaggaggagagtatacacatgttgttgcgaggtcagacctaaaaagagagattcaactaatattcgaaaaacagcgtgcatatgggcacgcctttgccactatggaaaacgaagacaaattcctccaaatttggtcaagccaaagaccatttgcgacaaaagatgacatagctaagaaaataggaaattgcacattcgaaccaaaagaaaaacgcgcacccaaatcaacgtacactttcgaaagattcagagcactagataaacttaatagattaaggattctaagcggaacctctcccgcaagatcattaactcaagaagaaagagatcttattttaaatagcctttttagcaagaaagaagtcaaatacaaagaactaagaaaattactgaaattaaacgacgaacaaagattcaacgaaattttctacgaccccaacgagaaaatagagaaaaacgaaaacagaacatttttatcgcttgaatcccaatataaaattagaaaaatactacaaaagatcgaaggaaaatcactaaatgatacttatcgacccgtcgacctagacacaatagcatacgctttaactgtattcaaagatgaccaagacatcagggattacttgcaaaatcagtacgtagcctcaaatggaaagaaagaactgaacttagcaaacaggaaatataacgatgaattaatagaagaactactacatttatcatttacaaaatttggacacctatcactgaaagcattgagaaacatacttccattcatggaacaaggtattccatatcaccaagcatgtgaaaaagccggataccaatttaacaagaaagttaatcgagagaaacaaaaacttcttcccccggtgccagctaaagacatagtcaacccagtcgtaattagatcgttaagccaggtaaggaaagtaataaacggaataataaaacgatacggaagtcccagtagtatctacatagaactcgcacgcgaaatgggaagaggatacaaagaaagaaaagacttggagaaacagtacaataaaaaccgtcaaatgaacgaaggtgcaaagaaacatatactcgaattacgccccgagtttggggatccaagaggccacgatatcttaaaatacaaattatggcaagaacaagattgcagatgtgcatatagttttaaaagtataccaataaaacaattattcgagataggatatgcagaagttgatcatataatcccatacagccggagtttcgacgacagtaataataataaagtcctagtactagctgcggaaaatcaaaacaaacaaaacagaacaccttatgaatggtttggacacgatgaaactaaatggcaagaatttacaagtctagtaactaccatgaaagtatccaaaaagaagaaatccttactgttaaagaaaaattttgatgaagaacaagcagaagagttcaggtcaagacacctaaacgatacgaggtatataacacgttacataaaaacatttatagaagacaacctacaattcagaatggaggaaggaaagaaacaatatgtacacacagtaaacggcgcatatacatcattaatgagaaaaaggtggggattcaataaaaatcgacaagaaaacgacttacatcatgcactagacgccgtaatagtagcagtaagcctaccattcaaacataaagtatcagcatacttcaaacgtagagaagaatacgcacataatcaactgaaaagggaaggggagttctttcctgaaccttggccaggctttatacacgaattagaaataagaatgatgcaagactcagaaaacataaaattagctatggaaagtttaaacctaaaaacttacgatgaatcattcataaaagaacttaaaccaatcttcgtatcgaggatgccgaaacgagcgatgcgaggtcaaatacacgaagaaacattaaaaagggtcagaggaagaactgacgacggatatatcagaacagtcaagaaagttaaattagaccaaatcccattcgataaaaatggagacttccctatgttcggaaaagaaactgatatgaaaacctacgaagccataaaaagtagatacttagaaagtggaaaagacaaaaagaaagcattcaacaccccgctatataaaccagccaaaaaccctgaaaacgcacccatcataagatcaattaaaatagaagaaaaagcgaacagagtcgtcatgctagatgagaaaaccgcagccgacaacgcatctatagtacgaacagaagtattcagacacaaagaaaccgggaattattttcttacaccggtttatgtcgcagatgtcttggcaaagaaagtacctgatagactaattactactaagaaaccatactcagaatggagaaaaatcacagacgaatatgaatttctgttctcgctgtacccaaacgacctaatacgagtaaaaatgccaaaagaaaaaggaacaaaaacacatactggtgaaaaacacgtatggcaagaaaacttcatgtattttaaaggagtccatagtggatctgcaggagtaagaatgatagaccatatgaactcattcgaagacgaaatcggagtaagaaaattagtcgtttttgaaaaatatcaggtagaccctctaggtagaatgaataaagttcatggcgagaaaaggcacggaatatga

SEQ ID NO: 5013 - RNA, 3234 nt, synthetic construct
  misc_feature 1..3234: note = Cas9 variant
  source 1..3234: mol_type = other RNA
atgcaacaaaaaccacaacgttatatacttggcttagatctagggattgcaagcgtaggatgggcttgtgtatgggcagacgaaaatgaacatccaacaggattgttagattgtggagtgaggacattcgaaagggcagaagtacctaagacaggagatagtttggctttagcaagaagacaagcaaggagcgtaaggcgcttaatacgaagacgagcacatagattattaagactaagaagactactaaagagagaaggggttttgctaagtgcagattttaacgaaaatggtctagtgaggggactccctatcgacgcctgggcactcagagtggcaggattagatagaaagttatccaataaagaatgggcagcagtacttttacacttagttaagcacaggggttatctaagccaaagaaagaatgaaactcagtcgaaagataaagaactaggaagattgctagcaggagtaaacggaaacagagaagcactgcaaaacaggtcagacgaatacagaacagccgccgaactagcagttaagaaattcgccgctgaaaataacgggtcgctaaggaataaaggaggagattatagccacacatttgatagaaaagatttacaaagagagctacatctattatttgaacgtcagagagcactggacaatccatttacaagttcagaaatggaagcagcagtggatgaattattaatgaaacagagatccgcacttcaaggtgaagcagtcttaaaaatgctaggtagatgtacatttgaaccgagcgaatataaagcagctaaaaatacgtattcagcagaaagatttgtatggttgacaaaattgaacaatttaaggattcaatataatggagaagagagagccttatccgaagcagaacgtaggcttcttttagatgagccctatcaaaaagctaaattaacatataaacaggtaagaacaatcctagaacttccagaaagtgcagtcttcaaagggttaagatacggccacggagaagatggtttaaaagctgaaagtggaacactaatggagatgaaggcataccacgcggtcaggaaagcattaaaagatgcaggacttgaaggagaatgggaaaataggatacggaacccagaattactcgatgccataggcacagcgttcagtctatataaaacagacgaagatattagagcaaatttagctgcttttagactttcagaaaatgtacttgaagcgttattagcaggattaaatttcgataaatttgttcacctctctctcaaggctctggctaaaatattaccgttaatggaacaaggaatgcgatacgatgaggcatgcaaggaagcatacggagatcattacggtgccaaagaacaagaagatcaccgactattaccaccattcgttgcagacgatataagaaaccctgttgttttcagaactttgacacaagcaagaaaaattgtaaatgaaatagttagaagatatggatcccctcttagagtacacattgagacaggtagggaagtcggaaagagcttcagtgaccgaaaagaaatagagaaaagacaagaagaaaaccgaaaagaaagagaacgtgcagcagcacattttaaagaactttttcctaatttcgccggtgaaccgaaggcacaagacatactgaaactgagattatatgaacaacaacatggaaaatgtttgtattcaggaaaagaaatagacctaagaagattaccagaaaaagggtatgtagaaatcgatcatgcactaccattttcgagaacctgggacgatagttttaacaacaaagttctcgtattaggtaaagaaaaccaagacaaaaggaacagaactccatacgaatatttagacggaaaaggcaatagtggagcatggagagcattcgcagaacgagtctcaggatgtcgatttccgtatgcaaagaaacaacgacttttaacgcaaaaactagatgagaaaacagaacaaggctttttagaaaggaatctgaatgacacacgatatgtcgcgagatttttatgtcaatttatagaagagaaaatgcacttggaaggtgcaggaaagaaaagagtatttgcttcaaacggtcaaataacagcgctattaagaggtttctggggtttaaagaaagtaagggaagaaaatgatagacatcacgctctagatgcagtagtcgtcgcctgcagttccgtaagtatgcagcagaaaataacacgacattttcgatatagagaagaattagaacatatagatagagaaacaggagaagtaatccatggatttccacaaccatgggaatttttccgccaagaagtcatgacaagagtatttagtgatgatccagtatctgaattagcagaaaaattagacagtcgaccagaagcagttcatgaatttgtaacccctctttttgtatcaagagcaccacacagaaaagtaacaggccaaggtcaccttgaaacaattagaagtgcaaaaagactagatgagaaaatatcagtagtaaaattaccgttgacacaattaaaaacaaaagacatagaaagaatagtcggatatccaaacagagaaccagcactatatgatgctctagcagcaaggctagcagcatttaaagatgatccagcaaaagcatttagtgaaccattctataaaactggaaaagatggaaaatgcggggttctagtcaaagctgtaagagtcgaaaatgtacagaaatcaggacttttggtaagaaaagatgaaagtggtaaaatgcaaggagtggcagataacgcaacgatggttcgcgtcgatgttttcggtaaaaacggaaagaattacttagtaccagtatatgcatggcaggttgaaaaaggtgaacttccaaatcgcgcagtagtagcatatgcagatgaagaagattgggatgaaatggatgatagttttgagttcaaatttagtttatacccaaatgacctagtagaagttgtgacaaagaaagacaaattctttggatattattcaggattcaatagagctactggtgctataaacattaaagaacatgatttaagcaaaagcaaagttaaaaatggagtatacgaaggtatcggggtaaaaactgcccaaagttttcaaaaatatcaagtagatacattgggtaaaactatccgattatgcaaacccgagaaaagaatgggctttaaaaagaaatga

SEQ ID NO: 5014 - RNA, 3237 nt, synthetic construct
  misc_feature 1..3237: note = Cas9 variant
  source 1..3237: mol_type = other RNA
atgagatatgttttaggtctagatataggaatagcttcatgtggatgggctgtcataaatcaagaaaaagaacgcatagaggacctaggagtaagaattttcgacaaagcagaaaatcccaaagacggcaaatcactcgcagcacccagaagagacgcacgctctacaagaagaacactcagaagaaagaaacaccgaatgcaacggatcaaagtcttacttgtaaaacacggattattatcaaaaacagagctagaccatttatacgaatcagcaactgaagtagacgtatggaacttacgattagacgccttagaacgtaaactgtacccaaaagagttcgcacggatactcatacacctcgcgaaacgaagaggcttcaaaagcaatcgaaaagaaacgaccctcagcgaaaatggtcagatattagaatctatctcagaaaatcaacaaataatggaaaaacagaactatcgaacggtaggagaaatgatactgaaagacaagaaattcgaaaatcataaaagaaacaaaaatggaacgtacgtaggtacagtaacaagacaacaactccaagacgaaattcaaatgatattccacgcacaaagactttacaaaaacgactacgctacagaggaatttgaatcttcatacttagaaatatgggctagtcaacgaccatacgcatcgaaagaccagatagagaaaatgataggttattgtaccctagaacccaaagagaaaagagcacccaaagcaagctggtcatttcaatacttcgtcgctctccagacaatcaataacttacgactgatatcaaaagaccgaatagaagaactatcatttgaagaaaagaaacagataatgaacttagcacttgaaaaatccatagtaaaatatatagatatcagaaaattactctctgtaccaaacgaatttcaatttaactcactctcttattccgcagataccgtagacacagcagtcgaatcacgaaaatgtatagaattaaaagaatatcactcgatcaacaaagtatataaacaaatatatggcgaaaatgcattaaaccttcttcctaaatactacgatacaatagcgtatggacttaccatattcaaagacgataaagatatactagaatacttacaaaacaaatatgtaaacgcaaaaggaaaacctatatcaaattttgcaaataaaacatatgatgatacatttattcaagcgctactcaacttaaactttaccaaaatgggacatctatcattcaaagcccttaaaaacattatcccatttctagaagaaggtttaagctacgacaaagcatgcgaaaaagcaggatacaactttaagggaacctcctacacagaacaaacaaaatatctacctgtcatacctcaaaacacaaacccagtagtccacagggcactaagccaaaccaggaaagtgattaacgcaattataaagaaatatggctctccaaacgcgattcacatagaaactgcaagagaactctctaaaacatttcaagaacgtaaagaaatcgactctatgtatcaagacaattctaagaaaaatgaacacgcaatccataaactaaaagaacttggaaacataaacccctcgggaataaacatcgtcaaatttaaactctggaacgaacaagacggtaggtgtatgtactcaggaaaatatatcgagccacacagactattcgaagaaggatacacagaagtagatcacattctaccatattcaagatcattagatgatagctataataacaaaaccctgacattaggaactgaaaaccaacgaaaaggaaacaaaataccctacgaatatatgggaaacacatctatatggaatgatttcgaaacacgagtgcaatcaaacaagaaaatcaacaaaaagaaacaacaaaaactccttttacaacacttctcttatgctcgagaacaagagttcatcgaaagaaacctaaatgatacgagatacgctactatatacttaagctcactgatacaacaacatctcatcttttcagaaagttcaaggaaaaagaaagtacacactgtatccggtataatcacatcacatctaagatccagatggggtttcaataaagatagaaaagaaggacacatacatcatgcactagatgctgtaatagtagctgtaacatccgaccacatgatccaaagagtaacaaaatattataaattaaaagaacttaatagaaatctacaagcaaaaagaatgccattccccgaaccctgggaaggcttcagactagaattagaagcccgaatatccccaaatacccaacagtaccttaaaggacttcgatttaaaaactatgcagacgtcaacctaagcgaaataaaatcaatatttgtaagtcgcatgccaaaacactcgataactggagaactacatcaagaaacaataaggaaattcataggatataacgaaaaagggaaagtattaacagccattaaaacaaaactagaagacatcccattcgatgcaaatggagacttccccatgtatggtaaagaatcagatttatatacatacaacgccatcaaagaaagatacctatcgcacaagaaagataaaagaaaatcatttcaagaaccactttataaacctacaaaatccggaggaataggacctctaatcaaatcaataaaaataatggatacaagaacaattgtgaaccccgtgaatcaaggaaaaggagttgtctacaactccaaaatcgctcgaaccgatgtatttaagaaagaagagaaatattaccttattcccatatacacaatagatttaatgaaaaacatccttccacaaaaagccataacagcaggaaaaggctacgaagattggacaacaatagacccttccttcacttttctattctcattattccccaacgatctaatacaaattgtcccttctaaaaataaaaccataaaagcaagaacgaccgtttccaagaaagaagtattactcccatcacttaccggctactttaaaggcgttcattcaggaacagcaggaataacagtagaaacacatgacgggtcagttatagcaaatgtcggcagcaaacagttacttttaatagaaaaataccaagtcgacgtcttgggtaactatactaaaataaaagaagagaaacgcatcggtttaacaacatataatgataacaagaaaatagcagcttgctga

SEQ ID NO: 5015 - RNA, 3237 nt, synthetic construct
  misc_feature 1..3237: note = Cas9 variant
  source 1..3237: mol_type = other RNA
atgaaacaacaaccacaaaggtatattctaggcctagatttaggaattgcatcagtagggtgggcactaatacttgtagatgaagaaggcaaccccataggactactagactgtggcgtaagaacattcgaaagagcagaagttcccaaaacaggcgattcgctagcacttgcaagaagacaagcaagaagcgtaagaaggttaatccgtcgcagagctcacagattactaagacttagaagacttctaaaaagagaaggtgtattgtcagcagctgactttaacagcgacggattacctaatctaccaatagacacatggcaactacgagtcgctggccttgaaagaaaactaacaaatcaagagtgggcagcagtccttttacatctagtcaaacatagaggatatttatcccaacgaaaaagcgaaacacaaacagaaaacaaagaattgggatgtttacttgcatcagttgccaaaaattcaaaattgctttcggaaaatgcaaaccaatatcgcactccggcggagttagcagttcgcctatttgccgaacaatcaggtcacttaagaaataaaggaggagattatactcatacattcaaccgactagatctacaaaaagagcttcacctcttattcgaacaacagcgaacatttggaaaccccttcgctagtgcagaattacaatcaaaagtggatggccttttaatgatgcagcgcagtgcactacaaggagaagctgtactaaaaatgctcgggaaatgcacgttcgaaccaagcgaatacaaagccgctaaacacacatactcagccgaaagattcatatggttaacaaaactaaataatttaagaattttagaaaacggaacagaaagagcgcttaatgaagcggaacgaaaattattactagatgaaccctacaagaaagctaaactaacgtatagccaggcacgcaaattattagatatgagtcacgatgcaacatttaaaggactaagatatggaaaagactcggaaggcctcaatgcagaaaacggtgctttaatggaaatgaaggcctaccataaaatacgaactgttctagataaagcaggactcaagggagaatgggaaaatcgcattagaaatccagaaattttagacaagataggaacagcattttcactctataaaacagatgaagatatacaagcagcgcttgcagatcttagacttccagaaaatgtacttaacgcactcttagcaggactaaacttcgacaaattcatacaactgtcactaaaggcattatcaaatataatgccattaatggaacgtggaataagatacgacgaagcctgtaaagaagtctacggagaccatagagctctagcagaaagcaaaaaccaaatgttacttcccccaataccggctaatgagattagaaatcccgttgtactccgaaccttaactcaaacacgtaaagtaataaacgcaataattcgtagatatggaagcccgcaacgtgtacacatagagaccgcaagggaactcggtaagagcttcaaggatagaaaagaaatcgaaaaacgtcaagaagaaaacagaaaagaaagggaaagagcggcagaacatttcaaagaactcttccctcatttcgcaggggagcctaagggtggagatatacttaaactaagattatatgaacaacaacaaggtaaatgcttatattcatccataccaatagatcttggaaggttaaatgaaaaaggatacgtcgaaatagaccacgctttaccttttagtcgaacatgggacgatagttttaacaataaagtattagtattaggttcagaaaatcaaaagaaaagaaatcaaacaccatacgaatatctcgacggggctagcaacagtcaaaggtggcgggagttccaagcacgattacaaggatgcagattttcatatgcaaagaaacaaagaatccagacagcaaaacttgatagtaaaacagagcaaggatttttagaaagaaacttaaatgatactagatatatagcacggttcctatgcggttttattgaggaaaacctacacttacaaggggaaggtaaaagaagagtatttgcctccaatggccaaataacagctttactaagaggactatggggcttaaagaaagtaagagaagaaaatgatcgacatcatgcattagatgcaatagtagtagcatgtagtactgtctcaatgcaacagaaaataacaaaagctatgcaaagaagagaaactttagaaacagtagatacagaaacaggagaagtaaaaacacgaataccacaaccatgggacttctttcgtcaagaagtcatgatgagagtatttagcgatacaccccacgaagaactggcggaaaaattatctggaagacctgaagcattacatgatttcgtaagtccactgtttgtctcacgagcacctaatagaaaaatgacgggacaaggtcatctcgaaacagttaaatctgcaaaaagattaagtgaaaatatttccgtcgtgagaaaaccactaactgcattaaaattaaaagatatcgagaatatagtcggatatccagatagagaaccagcattatatcaagcgttacgtgaaagattacaagcatacaaagatgatccagttaaggcattcgccgaacccttttacaaacctgccaaaaatggtgggcaaggatctctagtcaaagcagtcagagtaaaggacgtacagaaaacaggagtcatggttagaaaagatcgcggtggcattgcacgaggaatagccgataatgccactatggtaagagtagatgtattcggtaagaaaggtaaaaactatctagttcccgtctacgcttggcaagtcgcaaagggtatattaccaaacagagcagtagtagcatacgctgatgaagcagactgggatgaaatggatgactcatatgagttcaaatttacgttgtatccaaacgacctggtcgaaattataagcaagaaaggaaggatattcggatactatagtggattaaatcgagcaacaggcgcaatagatataaaagaacatgacctatctaaagaaaaagctaaaaatggtatacatcagagcgtaggagtaaaaactgtactatcatttcaaaaatatcaagtagatccacttggtaaagaaatctgcttgtgcaaagtagaaaaacatcccgagttaaacagcaaaaagaagaaatga

SEQ ID NO: 5016 - RNA, 3237 nt, synthetic construct
  misc_feature 1..3237: note = Cas9 variant
  source 1..3237: mol_type = other RNA
atgggatacttaatcggtttagatatcggaattacaagtgtaggatacgcagtactccaaaccgactttaaagggaacccgtacaaaatcttactcatgaatacagtcatattcccagttgctgaagcacctaaaactggggaatcacttgccgcacctgtgagacagaaacgatcctctcgacgcactaacagacgaacaaaattccgcaaattgcgagtacaaaaactattcgtccgattcggactcctagaatccgctgacgttgcaacatttctaaatcaaaaagtcccccatcaagatatctggcaattaagaaaagacgctctcaaccgcaaattatcaaacagagaactattcgaaatactatactttttcgtcggacatcgcggatttaaatctaacagaagaagtgaagtaacaggtaaacaaccaaaagataaccaagtagtactcacgtcgatccatgaccgcggcaacactttaaacgatttcgactcgctcggagaaatgatgcaagaattacccgagttcaaaacaataaaacataacaaagcataccgtccagacaatactatatacccattacgtgcatggatcgaacatgaactttctgccatattctcagtccaacagaaaaacaatagacaaatcaccgataattttataactcaataccttgatatattcagatcacaaagagatttcgaccaaggcccagcagctccaagtagattcggaggaaacatgatagaaagaatggtaggaccggattctctcgacgcccacgagaaaagagcagccaaattaaccaacacattctttagatttaactttctatcaacacttaacaatcttaaaatccaactcacacttggcgccgaatttcacccactcacaacaccccaaagagaaatagtactccaagcagcgaccctcaaatccttaaactacaaacaaatcagacataaactacaattacctgactcagcccgatttaacctcgtaccatatcaatctaacgaagacccaataaaaacagaatcaaaacattatttgttcaaacgaaaagccttaacacaaatagaagccgtaaccgacaacccacaactaatcgataaaatcggcacaatactagcatatttcaaaggagacaaaacccgacaggaaaaactgagcgcactcaacctctcaagagcagaaataaaacaacttttgccaatcaaccaaccaggattcggtaatctatcattaaaaacaatgcacaaaattctaccatatttagaacaaggccatctataccatgaagcagcacaactggctggctatgactttcaaaacaacctcgttgacaggcaatacctccgggataatctcaaaaaccccgtagtaaacagagccatcggaaaaacaataaaagtagtaaacgcaattataaagaaatacggggatcccgacgccatacatattgaactaacacgagaaatcaaacactctcacgaagagagacagaaaatagcaaggcaaatgaataccaacatggatcaaaatgataaagtcgccgaacatttaagagaaaacggaatacccgtaaatggtcaaaacataattaaatcaaaattattctatgaacaaaaaggaatagatctatatagtggacaacaaatcaacgaacaagacttatatactgaagaccattaccaagtagatcacattataccatattcaatatcattcaatgatagcttcaccaacaaaactgtcacgcgaacatctaacaatcaaaacaaagcaaatcgtttaccactagaatacctcagcgaagagaaacaagatgcatttagagcaagagtcatgagcaatatatcaaactacagaaaacgacaaaacctcttaaaagaaggtataactgaagataaccgacaacaatggaaaacacgtaatatcaatgatacaggatacataaatcgattactatcccaatatctcagaaacaatgtacaattcactaaaaagtctcataaccctgtgtttacagtcaatggagcaaccacagcttacattagaaaaaggtacggtataattaaaaatagacaagcaacagacctacaccatgcagtagatgcagtaatcatcggctgtatctcaaacacattcgtatcaagacttgccaaatattctgaagcacaagaagcacgatatcacaaacaactatggcaaataacacaatatagacaagaacataaagacttatcaaccatagagtaccaagaacttataaaacaattcccactcccatggccagacttccgacatgagttaatggctcgtctaagtacagacccagcaaaaatgatggctcatcacacatgggaacactacacagatgaagaaataagccaactaaaaccagccttcgtaataagatctgctaaccacaaagtgacaggatctgctcacgatgacacaatttacagcaagaaactatatgaccaacgtggagtaggcttacttcgaacatctctacaaaatctaaaatacgacagcaagaaagacggaattaaaaactacgaacggctaaaagatggcagcaacagtctagtctatgactcattactccgtgccctcaaagaacacgacggaaacgccaagaaagcattcccggacaaccaactactaatttcgacaggaaaccatcagcaaattataacacacgtcaaaacagtaaagaaaataacccaccctatagaagtaaatcgagacacagctattgcaataggaggaagaatgatcagagtcgacattttcaaacaagcaaaagcccaaaaattaattggaataccagtatacgtaaatgacacagtcaaaccaaccctaccaaacagagcctgcaccagtggtaaaagatattcagactggtatcaactcacaagacaagatcaatttctttgctccttagtgtcaaatgacctagtcctcgtagaaactgcctctccattaaaagtcacgaacaacattacaaacgaagaagtacaaactactcaactactgtgttacttttctagctttaatatagccaacgcacaaataaacttccatagtattaataatgactcctcaatcaatccaatagtactaaacaaagtaacatatttaacaaaatatcaattagactatttaggaaactactttccagtaaaacatgaaagcagaaaaactttcaatagaaaaagatga

SEQ ID NO: 5017 - RNA, 3237 nt, synthetic construct
  misc_feature 1..3237: note = Cas9 variant
  source 1..3237: mol_type = other RNA
atgcacacaagactagcattagatataggaacaaccagtataggatggatcctatatgaattggtaaacggacagccagcgtccatattagacggaggaactcgaattttcagtgatggtagagaagcgaaaacaggacattctttagcggtcgggaggagaacagcccgaggtatgagacgtcgacgagatcggtacttaagaaggcgtgcagcattgatgaaaagactagcagcaataggcttaatgccagaatctccagaagctgcagctcaactagcaacattagatccatatgaattacgagctagaggattagaccatccattaccaccagagcatttaggacgagctttattccaccttaatcaaagaagaggattcaagagtaacagacgaacagataaaggaaataacgaagggggtatgattgcggacgcgtcagcacgtttagagcaagcaatgatggcagctggtgcccgtagttacggcgaatttttacacaagagacgagcagaagcgacggctccaagagccactcccgcagttagaacaagaattaatccgcatctgactggagaagatggtaaggaacaaccaggttacgatttttacccagataggaaacacctcgaagacgaatttcatagattatgggaagctcaagctagacataatccagatctaactccagcaatgggggatttgctttttcaaactatatttcatcaaagacctctcaaggcgcctgcagttggaagatgtttatttttggatgaaccaagattaccaaaggcacatccactaacacaacagaggacactctatgagacagtgaacatgttaaggattgcaccaccaggtcaacctaaaagacgtctttctagagtacagagagatcaaatagtacacgctttaaataatagaaaaatactagcatcaccaggaaagaacgttttaaccttagcagccataggaaaactactaaaattacgaccaggagaagcattcagcttagatactgcaaacagagacgcaattgcctgcgatcctgtacgaatgagtttagcatatgaaggaagatttggtccacagtggagtgcattatcagtagaatcacagtgggaattaatacagcgtctgagagatgatcaagatggagcagcactcgttgactggataatggatcgctacggattcgacagagatagagcaagagcaattgcagacgctcctctaccggaaggctttggacgactcggtgagacggcaacaagagcagttttggctgtattaatagggggtaccacagagcaagaagttttaacctacagtgaagccgtagctgcatgtggatgggatcattcgcggctaggaacaggggaagttctagatagacttccatattatggacaagtattagacagacacgttctacccggtacgggcagaccagaagacgatgaaataacaagattcgggaggataacgaatccaacagttcatatagggctagggcaagtaaaaagacttgttaataaagtaattgacgcctggggacgaccacacgaaatggtagttgaattagctagggatttaaaaatgagtgaagatcaaaaacgcaatttagcaaaagtaaacgcccaaaaccaacgagcagcagaaatgcgatccgcaaaacttataggcgatttaaaaatagaagacaatggtaggaatagaggtatactcagggtatgggaagagagtgcagccgatgtattacacagatgttgtccatatacaggagcccaaataagtgcgtccatgctatttgatggatcatgtgatatagatcacatattgccatactcaagaacacttgatgatggttttaacaatagagttatatgtttaaaaagtgcaaaccgggagaaaagaaaccttaccccatgggaagcatggggaaatacacctaaatgggctgcaatagaagcaaatttaaagaatttaccaccggcaaaagcctggagatttgctccagatgcaatgttaagatatgaaggagaaagagactttacagcaagagcattagtagacacgcaatacttatcaagactagcccgagaatacctcgagtgtttatatgcggaggacatagatcctgggccacattccggtaagaaacctagaagacctatctgggtagtgacgggaaaactaactgaacttctacgaagacattggggcttaaatagcttattaccagatgctcacagaggaaccgctaaagccaaaaatagattagaccatagacaccatatgatagatgcagcagtagtaggagcaaccgatcacgcaacagtacaaagaatagcaaatatggcaaaaggaaatgttgaaaatggcttagaagacctagctggaaccatactaccaccatggccgggactaagagatgatctaaaagctagactcgaaagaacaatagtctcacatagaggcaaccacggagcaatcgaccctgcagctcgaaaacaaggacgagatacgacatcaggacaactacataatgacacggcttatggattaacaggagaaacattaaaaggagtcccccttgtagttaatagaaaaccaatagacatgttaacacccgccatgatagataaaattagagatccacatttaagccggtggctaactgctgtaacgaaaggcaaagaaggaaaagatttcaaagctgcggtagaagcatttcgagcccatccaggaccctatagaggaatcaggcgtgtaagattgatagaacccgtagaagtaattagaataaaagatagaaatgggagaccgtataaagggtataaaggcgacagcaatcagtgttatgaagtatggtgtttacccgatagaacattaacacaccatgttgtaagtacatttgcggcccaccaaggacaaactgggaaaccacacccagcagctaaaagattagcacgattatataaaggagacatggtaagactagatcgctcaaaattcggatcagtgattgcaacagtagaaaaatttgatagaaacggtcagctagagctagtaccccacaatgaaggcaatgcagatcaacgatatagaaaagataaaagtgattcagtattcattaggctacgagcagccaccttcatagcgagcggtgcaagacgcgtaatagttgatgagatggggaggatacgggaccctggtccagggaagcattga

SEQ ID NO: 5018 - RNA, 3240 nt, synthetic construct
  misc_feature 1..3240: note = Cas9 variant
  source 1..3240: mol_type = other RNA
atgaaatacggaataggactggactgcggtataaattcagttggatactgtataatggagcttaactctgacgacgaacctaaaagaatcgtaagacttaactcaagaatcttcactgaagcggaaaacccaaaagacggttccagtttagccgcaccaagaagagaagcaagaggattaaggagaagaatccgaagacacaaacaccgcctcgaaagaatcagagccttattagtcagagaaaacatagtaacacaagcggagttagacaatatgttctcaggaactctatcagacatttatgaattaagaacagcagccttagacgcacctttaaacaacattgaatttgcacgcgtactcataaacttagctcaacgaaggggatttaaaagcaacagaaagtcagaaaaatcatccagcgacaaagaaaccggcaaactgttaagcgctataaaaaaaaataaagagagtatagaagcaggaggataccgcacagtaggagaaatgctctttaaagatgaaagatatgccaagcacaaaagaaataaaggtgaagcttacctaaacaccgtgagccgagacatgatcgaggcagaaatccacgcagtctttgcctcacagagaaattttggaatgccatttgcaaacgaaaaaatcgaaaacgaatatacagacatcgcattgtcgcaaagacctttcgacctgggcccaggagaaggacccgaaaattgtaaatctccatacgcaggaaaacaaataaaaaatatgattggccaatgcaccttttttccagaagaaaaaagagcagtaaaagcctcctactcattccaactgtttagtctcttgcaaggaataaataatataactcttgtctcctctgacggaaatactttcccactaagtcaagaacaaagaaaaactcttaaagactactgctttaaaacagcaaatgtaacatatgcaagtatacgaaaggtactgcaaatacctcaagaatacactttcaaaaatataacatacacagacgatggaatcgaaaaaagcgaaaaaaaaaccaagttccaacacctcaaaccataccatgaaatgaaaaaggtactgggatcagcaatacaaacactcacaccagaagaacttgatgaaattggagaaatatttacgttctataaagacgaaacaatcataatcaaacaactagaagaaacagaaatagacaaatcattatatgatttattactccaactacccacatttgaaaaagcgggacacatatctacaaaagcctgtaagatgataataccatttttagaagaaggaaaaacatatgacaaagcctgcgaatgcgcaggtctcaacttcaaagcacacacaaatatgcagaaacaaatgcttctacctgcaaaatctgacgaactaaacgacgtagtaaacccagtagtccgaagagcaatcagccaaacgatcaaagtagttaatgctataatacgagagatgggtacttcacctacatacataaacatagaattagcaagagaacttagcaaatcaaaaaaagaaagagatgaaataaacaaaaaatataaattgaatcaggcagaaaacgaacgattaaagaatgaaataatagacaacttcaaaataaaaccaaacggacaagacataataaaactaaaactttggcacgaacaggacgatggaatatgcccatacaccggcgtcagaataaaatatgaaaacttatttgatgacggatacgcagaaattgatcatataataccgtactccttaagttttgacgactcatttaataacaaaatccttacaactgcaacccaaaatagacaaaaaggcaatcgaattccattggaatacctccccgaatcagaaaaagatggcttcagagtctgggttaacagcaacatacgcaaccatagaaaacgacaaaaccttctaaaagaacactttacagaagcagataaaaaagaatttaaaagcagaaatttaaatgatacccgttacttaaacaaactattgttaaactatatcaacgacaacctattattcactgatttctataacggaaaaaaaaagcatgtaacatcagttaacggggcagtaacagcctacatcaggaaaagatggggaattaataaaaatagagaagatggcgacctacatcatgcagtagatgcagccgtaatcgcctgtgtaactcaaggaataataaacagaataactgcatatagcgcaagaaatgaagcaccatacgatctgaataccgaaactggtgaaataaaggagcgattccccttaccataccccaatttcaaaaaggaactcgatgctaggacaactattgaagatgaaaaaaggttaaaaagggttctaatgagcttttcaaactattcatatgacgacgtcgaaaaggccaaaccgtgtttcgtgtctagaaccccccatagaaaagtaacaggagcagcacacgaagaaaccattcgaagcggcaaagtcgaaggatttactgtaagcaaaactgaactgactaaactaaagttaacaaatggagaaattgaaggatattacgaaccagaatctgacacactactatacaatgcgttacttcaaagacttaacgaattcggaggtgatgcaaaagcggcatttgccgacgaattccataaaccaaaagcagacgggactcccggacccgtagtaaaaaaagtaaagacaataaaaagatcctcgtctaacgttaaagcccgaaataagaacggattaggagtcgcagacaatggcagtatgataagaatcgatgtattttatgtagaaaatgaaggctactacttcgtcccaatctatgttgcagacacagtaaaagagatgccaaatgaggcatgtcctttcggtaaggataaaaaaaaaattatgacggacgacgactttctattcagcttatatccaaatgatctaataaaaattacagctaaaaaagacatgaagttcagccttgcgaacaaagaatccggactgccaaaaaataaatacgctaatgaagtattagtatattactcagcagcagacattagcaacgcaagcatttctgtcataatgcatgataatgcatacaaattcagaggatgtggaattaaatcattagttaaactagaaaaatacacggtggaccctctcggtaacgtatctaaagtcaatagggaaaaaaggatgtattttaaatga

SEQ ID NO: 5019 - RNA, 3240 nt, synthetic construct
  misc_feature 1..3240: note = Cas9 variant
  source 1..3240: mol_type = other RNA
atgagactaggccttgatattggaacctcatccataggatggtggttatatgaaactgatggggctggatcggatgcaagaataacaggcgtagtcgacggaggtgtaagaatattctcagatggaagggacccaaaaagcggcgcatcgttagctgtagataggagagccgcaagagcaatgagaagaagaagggatcgatatctacgacgccgtgcaacattaatgaaagtgctagcagaaacgggattaatgcctgcagaccctgcagaagcaaaggctttagaagcactagacccttttgccttaagagctgccggtctagatgaacctttaccactgcctcatttgggtagggcactatttcacttaaatcaaaggcgaggctttaaaagtaatcgaaaaaccgacagaggtgataatgagagtgggaaaattaaggatgcaactgctagactagatatggaaatgatggctaatggagctcggacatatggtgagttccttcacaaacgaagacaaaaagcaacagatcctcgacatgtccctagcgtcagaaccagattatcaatagctaatcggggaggcccggacggcaaggaagaagcaggatatgatttttatccagatcgtagacacttagaagaagaatttcataaactatgggcagcacaaggagcccatcatccagaattaacagaaacgctaagagacttgctatttgagaaaatcttctttcaaaggccactaaaagaacccgaagttggattatgtttattttctgggcatcatggagtaccacccaaagatccccgtctgccaaaagcacaccctctaactcaaaggagagtcctttacgaaacagtaaatcaattaagagttacagctgacggaagagaagctcgcccattaactagagaagaacgagatcaagttattcatgcactggataacaaaaagccaacgaaatctctttcgtcaatggtactaaaactaccagctttagcaaaagtattaaaactacgagacggagaaagatttaccctagaaactggagtccgagacgcgatagcatgcgatcccttacgtgcaagcccggcccatccagataggtttggtccaaggtggagcattttagatgcggacgctcaatgggaagtaattagtagaatacgaagagtacaatcagatgcagaacatgctgccctagttgactggttaaccgaagcacacggattagacagagcacacgcagaagcaactgctcacgctccattaccagatggatatgggagattaggattaacggcaacaaccagaatcttatatcaactaactgcagacgtagtaacatatgccgacgccgtaaaagcatgtggctggcaccattcagatggacgaacaggcgaatgttttgacaggttaccatactacggtgaagtattagaaagacacgtcataccgggctcgtaccatcctgatgatgatgatataactaggtttggaagaataaccaacccgacagtacatataggactaaatcaattgagaagactcgtcaatagaataatcgaaacacacggaaaaccacaccaaatcgtagtagaattagcaagagacctaaagaaatcagaagaacaaaagagagcagatataaaacgcataagagacactacagaagcagcaaagaaacgcagcgagaaactagaggaattagagatagaagataacggccgtaatcgaatgttattgagattatgggaagacctaaatccagacgatgctatgaggaggttttgtccctacaccggtaccaggatatcagcagcaatgatattcgacggttcatgtgatgtagaccatatattaccatacagcagaacgctcgatgattcttttcccaataggacactttgccttagagaagcaaatagacagaaaagaaatcaaaccccatggcaagcatggggtgatacgcctcattggcacgcaatagctgcaaatttaaagaatctaccagagaacaaaagatggagatttgcaccagacgcaatgacccggtttgaaggggaaaatggatttttagatagggcattaaaagatactcaatatcttgcaagaataagtagaagctacctagataccttatttacaaaaggtggtcatgtgtgggtggttccaggaaggtttaccgagatgcttagaagacactggggattaaatagtttattatcagatgcgggtcgaggggctgtaaaagccaaaaatcgcactgatcacagacaccatgccatagacgcagcagtcattgcagcaacagatccaggactattaaacagaatatcaagagcagcaggtcaaggtgaagcagcaggacaaagcgcagaacttatcgccagagataccccacccccatgggagggattcagagatgatctcagagtaagattagatagaataatagtaagccatcgggctgatcatgggaggatagatcacgcagccagaaaacaaggacgcgattccacagcgggacaacttcaccaagaaacggcatatagtatagttgatgacatacatgtcgcatcaagaacagatctcctaagtctaaaaccagcgcaattattggacgaaccaggaaggagtggacaagtacgcgaccctcaactacgaaaagcattaagagtggccaccggaggtaagacaggcaaggactttgaaaatgctctgagatattttgccagcaaacccggcccatatcaagcgatacgaagagtgagaataatcaagccattgcaagcacaagcaagagtaccagttcccgcacaagatcccatcaaagcctatcaaggtggttctaatcatcttttcgaaatttggaggctaccagatggtgaaatagaagcgcaagtaataacatcgtttgaagcacacactttagaaggagagaaaagaccacaccctgctgcaaaaagattactaagagttcacaaaggtgatatggtcgcactagaaagggacgggagaagagtagtcggacacgtacagaaaatggacatagcaaatggattatttatagtcccacacaatgaagcgaatgcggatacccgtaataatgataaatcagatcctttcaaatggatacaaataggagcaaggcccgcaattgcatcaggcataagaagagtaagtgtcgatgaaataggaagattaagagatggaggaacaagaccaatctga

SEQ ID NO: 5020 - RNA, 3240 nt, synthetic construct
  misc_feature 1..3240: note = Cas9 variant
  source 1..3240: mol_type = other RNA
atggacgaagaagcgaaaatacaattaagtaaagaatcttatgaagaagaactcgaatctttactagagaaaagtggagaagaatttagagatgtgttcctacaagccaaaaaggtatatgacgcaatcttgttaagcgacatactaagcacaaagaaacaaaattcaaaagcaaaattatccttaggaatgatcgaaagatatgactcacataagaaagatctagaggaactaaaacaatttgtaaaagcaaacctaccagagaaaacagccatatttttcaaagacagcagtaaaaacggatatgcaggctacatagacggaaagacgactcaagaagacttctacaaatttctaaagaaagaactaaacggaatcgctggctcagaacgctttatggaaaaagttgaccaagaaaacttcctcctcaaacaacgcacaacagctaacggcgtaataccacaccaagtgcatttaacagaactcaaagccataattgaaagacaaaaaccctactacccattcttagaagaggcacgggataagatgataagattactaacttttagaataccatattacgtaggaccgttagcacaaggtgaagaaacaagttcgttcgcatggttggaaaggaagacaccagagaaagtaacaccatggaacgcaaccgaagtaatagattatagcgcatctgcaatgaaattcatacaaagaatgataaactatgacacctatctaccaactgaaaaagtcctaccaaaacattctatattgtaccaaaaatatacaatattcaacgaactaacaaaagtggcatacaaagacgaacgaggaataaaacaccaattttcgtcaaaggaaaaacgagaaatatttaaagagctattccaaaaacaacgaaaagtgaccgtcaagaaattacaacaatttctaagcgcgaactataacatagaagacgcggagattttaggcgtcgacaaagcattcaactcctcatatgcaacatatcacgacttcctagacctagccaaacccaacacagaacgtgtcgcagaattacttgaacaaccagagatgaatgcaatgttcgaagacatagttaaaatactcacaatatttgaagatagggaaatgatcagaacacaactcaagaaatatcaaagcgtattaggtgatggattctttaagaaattagtaaagaaacattacacaggatggggtagattaagtgaaagattaatcaacggcatcagagacaagaaaactaacaaaacaattctagattacctaatagacgacgacgacttcccatataacagaaatagaaacttcatgcaactaataaacgacgattcactatcattcaaagaagaattagccaacgaactcgcattggcaggcaaccaaagtttactagaagtagtagaagccttaccaggttcaccagccataaagaaaggaatttggcaaaccttgaaaatagtagaagaactcatagaaataataggatacaatccgaaaaatatagtagtagaaatggcacgtgaaaatcagagaactaacagaagcaaacccagactaaaagctctcgaagaagcactcaaatcgtttgatagtcccctcctgaaagaacaaccagtcgacaaccaagccctacagaaagacaggttatacctttattatctacaaaacgggaaagatatgtacacaggtgaagccctagatatagatagactatccgaatacgacatagaccacataataccacgaagtttcatagtcgataacagcatagacaacaaagttctagtatcaagtaaagaaaatcgattgaaaatggacgacgttcctgatcaaaaagtcgtcatccgaatgcgaagatattgggaaaaactgttaagagcaaacctaatcagtgaaagaaaattcgcttatcttacaaaacttgagttaacacctgaagacaaagcacgatttattcagagacagctagtagaaaccagacaaatcactaaacacgtagccgccatattagaccaatatttcaatcaaccagaagaatccaaaaacaaaggaatacggatcatcactctaaagtcaagcctagtatcacaattcagaaaaacattcggcatacataaagttagagaaataaacaatcatcaccacgcacatgatgcctacctaaatggcgtagttgcaatagcgttactcaaaaagtacccaaaattagaacccgagttcgtctatggaaattacacaaaatttaatttggcaacagaaaacaaagcaacagccaagaaagaattttattcaaatatattacgatttttcgaaaaagaagaatacagctatgacgagaatggagaaatattttgggataaggcaagacacatacctcaaatcaagaaagtaataagtagccaccaagttaatatagtcaagaaagtagaagtccaaaccggaggattttataaagaaacagtaaacccaaaaggtaaaccagataaactaattcaaagaaaagcgggttgggacgtcagcaaatacggaggcttcggttcaccagtagttgcctacgcagtcgcatttatatatgaaaaaggtaaagcacgaaagaaagcaaaagcaatagaaggtataacaataatgaaacaatcattattcgaacaagaccccataggctttttatcaaacaaaggctattcaaacgttacaaaatttattaaattatccaaatatacactctatgaacttgaaaatggaagaagacgtatggtagcaagccacaaagaggcccaaaaagccaattcatttatacttccagaaaagctagtgactttactattctacgcccaacactacgatgaaatagcacacaaagaaagttttgactacgtcaacgaccatttaagcgagttccgtgaaatcttagaccaagtaatagatttcagcaatagatacacgatagccgcgaaaaacactgagaaaatcgcagaattatttgaacaaaaccaagaatcaaccgtacaatcattgagtcaatcatttataaatctcatgcaacttaatgcaatgggagccccagctgatttcaaattcttcgacgtaataatacccagaaaaagatatccatccttaacagaaatatgggaatcaactattatataccaaagtataaccggactgagggaaactcgcacaagaatggcgaccttatgggatggtgaacaatga

SEQ ID NO: 5021 - RNA, 3240 nt, synthetic construct
  misc_feature 1..3240: note = Cas9 variant
  source 1..3240: mol_type = other RNA
atggacgaagaagccaaaatacaactatcgaaagaaagttacgaagaagaattggaatcactgctcgaaaaatcaggtgaagagttcagggatgttttcttacaagctaaaaaggtgtatgacgcaatattattatcagatatactatcgacgaagaaacaaaattcaaaagcaaaactatcattaggtatgatcgaaagatatgactcgcacaagaaagatttagaagaactcaaacaattcgtgaaagcaaatctgccagagaaaaccgcaatatttttcaaagactccagtaaaaatggatatgcaggatacattgacggaaaaacaacacaagaagacttttacaagttcttaaagaaagaactaaatggtattgcaggatcagaaagattcatggaaaaagtagaccaagaaaactttttacttaaacaacgaacaacagcaaatggagttattccacatcaagtacatctcacagaattgaaagcaataatcgaaaggcaaaaaccgtattatccttcattggaagaagccagagacaaaatgatacgcctactaacctttagaatcccctattacgtaggaccattagcacaaggagaagaaacaagctcatttgcatggttagaacgaaaaactccagaaaaagtaacaccttggaatgcaacagaagtaattgactacagtgcttctgcaatgaaattcatacaaagaatgattaattatgacacatatttaccaactgaaaaagtattaccgaaacactcaatactctaccaaaaatatacaatattcaacgaattgaccaaagtggcatataaagacgaaagaggtattaaacaccaattttcatcaaaagaaaaacgagaaatatttaaagaattatttcaaaaacaaagaaaagtaaccgtcaaaaagctacaacaattcttatcagccaattataatatagaagatgcagaaatcctcggagtagataaagcatttaactcctcatacgcaacttaccacgactttcttgatctcgccaaaccgaacaccgaaagagtagctgaacttctggaacaaccagaaatgaacgcaatgttcgaagacatcgtaaaaatactcacaattttcgaagatcgagaaatgatccgaacacaattaaagaaatatcaatccgtactaggcgacggattcttcaaaaagctagtcaagaaacactacactggttggggaagattatcagaacgactaataaatggaataagagataagaaaacaaacaaaacaatattagattacctaatagacgatgacgacttcccatataacagaaaccgaaatttcatgcaattaataaatgacgactcactcagctttaaagaagaattagccaatgaactcgcgctagctggcaaccaatcattgctcgaagtagtagaagcactactaggttcaccagccattaagaaaggaatatggcaaacactaaaaatagtagaagaactaatagaaataatcggttacaatcccaaaaatatcgtggtcgaaatggcgagagaaaaccaaagaacaaatagaagtaaaccacggctaaaagcactagaagaagcactcaaatccttcgactcacctttactgaaagaacaaccagttgacaaccaagcactacagaaagataggctatatttatactacttacaaaacggaaaagatatgtatacaggagaagctctagacatagataggttatcagaatacgatatagaccacattattcctcggtcattcatagttgacaactcaattgataacaaagtcttagtaagctcaaaagaaaaccgactaaaaatggacgatgttccagatcaaaaagtggtaattagaatgagaagatattgggaaaaactcctacgagctaacctaatatcagaacgaaaatttgcatatctaacaaaactggaattaaccccagaagacaaagctcgattcatacaaagacaactcgtagaaacaagacaaataactaaacacgtcgcagcaatactagatcaatactttaaccaaccagaagaaagtaaaaacaaaggtatcagaatcatcacgctcaaatcatctctagtatcacaatttagaaaaactttcggcataaacaaagttagagaaatcaacaaccatcaccatgcccatgacgcatatctaaacggagtagtagcgatagcattactaaagaaatatcccaaactggaaccagagttcgtatatggaaactatactaaatttaacctcgccaccgaaaacaaagccacagctaagaaagagttctattcaaacatcttacgattctttgaaaaagaagaatactcctatgatgaaaacggcgaaatattctgggacaaagcaagacatataccccaaataaagaaagtcatcagctcacaccaagtcaatatagtgaagaaagttgaagtacagaccggcggtttctacaaagaaacagtcaaccccaaaggaaaaccggataaactaatacagcgtaaagcaggttgggacgtcagcaaatacggaggctttggaagcccagtcgttgcctacgccgtagcatttatatacgaaaaaggaaaagcaagaaagaaagcaaaagcaatagaaggaataacaataatgaaacaaagtttattcgaacaagaccccatcggattccttagtaataaaggttacagcaacgtcacaaaattcatcaaactgtcaaaatacacattatatgaactagaaaatggaaggcgtcgaatggtggcttcacataaagaagcacaaaaagctaacagcttcatactacccgaaaaattagtcactttactttaccatgcacaacattacgacgaaatagcccacaaagaatcctttgactatgtaaatgaccacttaagcgaatttagggaaatactagaccaagtaatagactttagcaaccgttatactatcgcagcgaaaaacactgagaaaatcgccgaactattcgaacaaaaccaagaatcaacagtacaatctctatcccagagcttcattaatttaatgcaacttaacgcgatgggagcacccgccgactttaaatttttcgacgtaataataccccgtaaaaggtatccaagcctaacagaaatctgggaaagcacaataatatatcaatcaataaccggtctgcgagaaaccagaacacggatggcaacactctgggacggagaacaatga

SEQ ID NO: 5022 - RNA, 3243 nt, synthetic construct
  misc_feature 1..3243: note = Cas9 variant
  source 1..3243: mol_type = other RNA
atgaaaactagcttcgccttcgatataggaacgaacagcattggttggtgcgtattggctttagacaatgcaaacctgccttatagaatattagatgctggcgtaagaatttttagcgacgggagggaaccaaaatcaggaacatccttagctgagggtagaagattagctcgcggaatgagtagaagacgtgataggtacaaacgaagaagaaaagcagtcatccgtacactaatcgaatatggactaatgccagatgatccagctgctagaagggcattagtagcggaaaccaacgacaaagctccaggcaaaatcgcaagcgacgtgtatgcattaagagctagagctttagatgataaattgccattacatcatattggtagagctctatttcatattaaccaacgaagaggattcaaatcaaacagaaaaactgataaacgagataacgaccaaggtaaaatagcatctggtatctcccgacttagagacaaactagcatcagaaggaatgcgtacactaggagaatatctaaatcatagacatcaagcaggaaattgggttagagtaagaccatcaagagtacctggtaaagatgataaagaagaagacggttacggattttatccagaacgtgccctattgcaagatgagttcaatgctatatggacagcccaagcagcgcactatcctgacgtattaacagaagaaagaagaacacatctagaaacaataattttctttcaaagacctctaaaaccagtccaagtaggaaaatgcagttttaatcccggagaagaaagactcccacgagcacatcccttattccaagaatttcgactttataaagaagtaaatgaactagagctagttgacagaaatcaagatcaccacaaattatcgctagatcaaagagacgcattaatagcacaattgaaaacacaaagagaagccgcctattcagcgctaagaaaaacggcgcgagcaccacttgggacgcgcttcaataaagaaactgaatcccgaacgaaaatgaaaggagacgaagtcgccgcagaactatctgcaaaaaccagattcggacaggcttggatatcgatgcctctggaagaaagatggataattgtagataccttgagacgagtagaagacccactagagctaacagcttggctagagcaacattacggactagacggagaacatatagatgcaatactagcagcccggctcccagaaggatatggaagattaggagaaacagctttaaccgaaatattggtcgagttaaaggccgccgtaataagcgaagcagaagctgctaggagagcaggatatgatcatgccttattacaaagaggagctggactagaagcattaccaaaataccaagaagttatagcccgcaggatccctcccggaacagggaatccggatgatccctatgacgttgaaaaaggccggatcactaatccaactgttcacatcggcttaaaccaactacaaaaagtcttaaatgcgcttatacgtcgatatggaaaacctgaacaaattgcaatcgaactagcacgtgaattaaaattaaacgacgaacagaaaagagaaaagaacatagaaatagccagaaatactagagcagcggaacaacgctcagcaaaattagtagaacttggcgtgcctgatacaggatataatcgtgtgcttctaaaactttgggaagaactaaacctgcgagcaccagagaacagagtttgcatctactgcggtgaaccaattaatatcgaaacactattctctagcgcagtagatatagatcatatactaccctggtcaaaaacactggatgattctcaagccaataggctagtttgccacgtggcctgtaacaggcaaaaggctaattatgcgccagcagaagtaccacaatggcaaggaagatacgacgacatattagcaagggcaaatacactaccattgaataaacgatggagatttggaagagacgcgatgaaaaagttcgcagacgaagaaacatttctagctagacaactaaccgatacacaatatttaagtagattagctcatgcctatatggcggctctttacccggatgaagaacctgatgcacaaggagttctagcaaggaaaaatcacgtcagagttatcacagggcgaatgacagaaatgttacgaaggcaatggggtctcaattcactactagctgatcataatcagaaaaacaggaatgaccacagacaccacgcaattgatgcagcagtagttggggtaacaacacgagctcttttacaaaggatagccacagtggcagggggaagagaagcacaagcacttgaagaaaccataggaaaaattgaacccccatggcccggctttcgtgatgagctccaagctgtaataaaacgaattgtagtatcacataaaccagatcacggtacgttgccaaaaccaggacaaggtggacaaacagctggtcaactacataatgatactgcttacgggctaacaggcgaaaccgattcaagaggaacgcctatagtagtaagacgaaaacccttcacttcattaaccgaaaaggacttaccatcaattagagatagacaattagcccaggcactaggttctgctatagcgggaaggtctggaaaagagttgcaagcagcacttgaacaattcagggatagagacgactataaaagcatcagacatgtacgtgtagtagaacctctaaacgtcataccaataagggatggaacaggcagagcttataaagcgtacaaaggagatgctaattacagatatgatgtctgggaactaccaaatggaaaatggatgcatgaggtagtaagtatgttcgacgctcatgatagatcgtggacaagtgcagtacacatacatcacccagcggcacgaagagtattgtcactaaaacaaaatgacatggtagcatatgaccatccgcaagacggaccaacaataggtagagtagttaaattctcacaaagcggacaaatgacatttgcccctcataaagaagctggagctctcaaagcacgagatgctgaccctgaagatagattccgatatttctacaaatcaggttcagcaatgaaagatataggactacgtcaagtaagagtcgacgaaattggcagagtatttgatcccggaccaagagacaaagaagcgagaaacgcaagaaagaagaaatcgacagattga

SEQ ID NO: 5023 - RNA, 3243 nt, synthetic construct
  misc_feature 1..3243: note = Cas9 variant
  source 1..3243: mol_type = other RNA
atggcaaaatctttcgcattcgatatgggtaccaacagtataggatgggcagtattaggtctagatagcgcgggagatccagattcaatagaaggtgcaggcgtccgtatttttagcgacggaagagaacccaagagtggagctagcttagctgaaggtaggcgaatcgcaagaggaatgagcagacggcgagaaagatataaagcacgacgaaaggcactaataaggacacttggtgattatggattaatgcccctagaaagggctgctagacgagcgttagtggcagagaccaacgacagatcctttggcctagtcgcccaggatgtatatgcgctaagagcaagagccttagtagaaaaactaccaccctatcatttggggcgagcactgttccacctgaatcaaagacgaggttttaaatcaaatcggaaaacagacggacgagataatgaactaggtatgatagcaactggaatagctgcattagacgcacaattaaacggccgtacccttgggcagtaccttcatgaaatgaggggtgctgatcctagacaaagggggcaagtcagagtcaggccacatctagaaataaatgataaaggaagagaaattgcggcatacggattttatcctcagcgcgcaatgttagaaagggaatttaatgcaatatgggcagcacaagcaccacatcatccagaattactcagcgaagaacggagagcacatttatttcaagtcatcttttaccaaagacccctgaagcaaccagatccaggaaggtgttcctttaatccagcagaaccccgcctggccaaagcccatcctctatttcaaaggttccgcctagtaaaagagataaatgaactgagaattgtaacaggtagcaatagtcagggagtaccattaactctagaacaacgcgatatcctactaacgctactaagagataagaaagcatctagttttaaaacattattagcaaaaataataaaaggacaaccagaagccagattcaacaaggcttctgacagcagagataaaatgaaaggggatgaactagcagcgactatgagtgacaaaacgagattcggacaagcatggtttgcaatgcctgaagcagaacaatggaggatcattgctaaattaagagatatagacgaccccttagaattaaatgcatggttagaaagcgaatatggactagctccggagagaagggatgcagtagcaaatgcattactacctcaaggatatggacgactaggagaaacagccttaagaacaatgttagattatcttgaagccgcagtaattagtgaggcagaagctgcagctcaggccggctacgatcatgccctagctagaagaggagcaggcttagatcaactacccaaatatcaagaagtattaggacgccgtatacctccaggaagtggcgagccaaacgatccgtacgacataaggatgggacgcatttctaacccaactgttcacatagcactaaaccaattaagaagggtagtaaatgcactaatacgcaagtacggtaagccagcagaaattgctatagaactagcaagagatttaaaactatcagaggaacaaaagagagaagtaaatgcaactatcgcaaagaacaccagagatgcggaaagacgagcagtaagattagcagatgaaggtattgataatacagggcacaacagagctttattacgtttctgggaggagttagcggcggacccactagatcgagtttgtgtatattgcggtgggggtataggagcggcaagtctatttaacggaagtgtagacatcgatcacatattaccttggtctagaaccttagacgatagcagggcaaatagaatattggttcacaacagctgtaacaggcttaaaagaaactttgcgccatttgaagtaccggaatggcgagaaatatatcaagacatattagtaagagcagctaaactaccagcaaataaaagttggagatttgcacctgacgcaatggatcgattcgaaggagagaaagatttcctagccagacaattaacagatacacagtatctggcaagaatggctcacgaatatttagcagccttatatccggatgaggaacctgatgaatggggagtattcgcacgcggaaatcatgtaagagtggtaccagggagactaacagaaatgctcaggagagcatggggtttaaatgcaatccttagtgatgataacagaaagaatagaaatgaccaccgacatcacgccatagatgcagtcgttgtaggagtcaccacgagagacatgttgaacaaaatatcacaagcagcaggaagaggagcagatatgggtgcagcagatgcgttgcgaagatttgatcctccatggccatcattccaccaagccgtaagagcagccgtcgaaagaatattagtcagccatcgagcagatcatgggaccttacccggaactgacggacaaggaagtacagcaggtcaacttcataatgatacagcatatggtttaacaggggaaaccagaaaaggattagcggttgtagttcgtagaaaaccatatttatctttagaaccgcgtgatatagaaactatcagagacccacaattaagagatcatctagccacagaaacctatgggctcgcgggagccgagttcacggcagcgctaaaaagattacaacaaacagacaaattttatgcaggaatacgacgagttagagtaacggaagcattaagtgtaataccgataagagatgctacgggacacgcgtataaagcatacaaaggagatgctaattttcgttatgatgtgtgggaattacccaatggaaaatgggttcctgaagttataagtatgtttgatgcgcatgatagaggatgggtgtcccaagtacatgctgcaaatccagccgcacgacgtgtcttaagcctcagacaaaatgacatggttgcttaccagcacccggaacaaggcctagtatacggaagagtagtaaaattcgggcaatcaggccaaatgactttcgcagcacaccacgaagggggatctttaaaaagtcgcgacgccgatagagatgatccatttaaatatttctacaagtctgcaggaacaatgaaagatataggattaagacagataagagtagatgaaataggtagagtacaagatccaggacctcaagatcgagattcaaaaagagtacgaaaaagcgacaggtga

SEQ ID NO: 5024 - RNA, 3246 nt, synthetic construct
  misc_feature 1..3246: note = Cas9 variant
  source 1..3246: mol_type = other RNA
atggctgcgtttaaacccaatcccatcaactatatattaggactagatataggtatagcatctgtaggatgggccatggtagaaatagacgaagatgaaaaccctatctgtcttatagacctaggagtacgtgtatttgaaagagcagaagtaccaaaaactggcgatagtctggctatggcaagacgattagccagatcagtaagaagattaaccaggagacgagcacatcgactactacgtgctaggaggttactcaaaagagaaggcgtgctacaagcagccgattttgatgaaaatggcttaataaaaagtttaccaaataccccatggcaactccgagcagcagcgcttgataggaaattaacacccctggaatggagcgcagtgctattacatctcataaaacatcgtggatacctcagccaacgtaaaaacgaaggggaaactgccgacaaagaattaggtgcattactgaaaggggtagcagataatgcacacgccctgcaaacaggcgatttcagaacacccgctaaattagcactaaacaaatttgaaaaagaatcaggtcacatacgaaaccaaagaggagattacagccatactttctcacggaaagacttacaagctgaactgaacttactatttgaaaaacaaaaagaatttggcaaccctcacataagcgatggcctgaaagaaggaatcgaaacgcttcttatgacacagagaccagcattaagcggagatgctgtacaaaagatgctcggtcactgcacatttgagccaacagaacccaaagcagctaaaaacacatacactgcagaaaggtttgtatggcttacaaaactcaacaatttacggatattagaacaagggtcagaacaaccattaacagatacacaaagggcaaaattgatggacgaaccctaccgtaaatcaaaattaacatatgcccaagcaagaaaactactcggactcgaagatacggcattcttcaaaggactacgctatggaaaagataatgcagaggcttctactctaatggaaatgaaagcgtatcatgcaattagcagagctctagaaaaagaagggttaaaagataagaaaagtcccctcaatttatcacctgaattacaagatgaaataggtacagcctttagtttgttcaaaacagatgaagacataactggaagactaaaagaccgagtacaaccagaaatattagaagcattattaaaacatatttctttcgacaaattcgtacaaatctctttaaaagcactaagaagaatagtaccactaatggaacaaggtaaacgttacaacgaagcctgcgcagagatctatggagatcattacgggaagaaaaatacggaagagaaaatatatttacctccaataccagctgatgaaataagaaatcccgtagtcttaagggcattaagtcaagcaagaaaagtaataaatggagtagtgaggcgatacgggagtccggcgaggattcatatcgaaacagcgagagaagtaggtaaaagttttaaagatcggaaagaaatagaaaaacgacaagaagaaaacagaaaagacagagagaaagcagcagcaaaatttcaagagtattttcccaatttcgtaggcgaaccaaaatcaaaagacattttaaaacttagactatatgaacaacaacatgggaaatgtctatattcgggaaaagaaataaatttaggaagattaaatgaaaaaggctatgtagaaatagaccatgcattaccattttccagaacatgggatgactcgttcaataataaagttcttgttctgggttcagaaaatcaaaacaaaggaaatcaaacaccgtatgaatattttaacggaaaagataacagtcgtgaatggcaagagtttaaagctagggttgaaaccagcagatttccaaggagtaaaaagcaaaggattttattacaaaaatttgatgaggatggatttaaagaaagaaatcttaatgacacgaggtatgtaaaccgattcttatgtcaatttgtagcagatcgaatgagactaactggaaaaggtaagaaacgagtgtttgcatccaatggacaaattacaaacttgctaagaggcttctggggtttaagaaaagttagagctgagaacgacaggcaccatgctctagacgcagtcgtagtagcatgttccacagtcgctatgcaacagaaaataacccgttttgttcggtacaaagaaatgaacgcattcgatggaaaaacaatagataaagaaaccggagaagtacttcaccaaaagactcatttcccacaaccatgggaatttttcgcacaagaagtgatgataagggttttcggaaaaccagatggaaaacctgagttcgaagaagctgatacacccgaaaagctaagaacgttattagcggaaaaattatctagcagacctgaagcagtccacgaatatgttactcctctattcgtctctagagcaccaaataggaaaatgagtggacaaggacacatggaaacggtaaaaagtgctaaacgattagacgaaggagtgtcagtactaagggtgccattgacacaattaaaattaaaagatttagagaaaatggtaaatagggaaagggaaccaaaattatacgaagcactaaaagcacggctagaagcacataaggatgatccagcaaaagcgttcgccgaacccttctacaaatatgataaagcaggaaacagaacacaacaagttaaagcggtgcgagtagaacaagttcagaaaacaggagtatgggttagaaatcataacggaatagccgataacgcaacaatggtaagagttgatgttttcgaaaaaggagataaatattacctagttccaatatattcatggcaagttgcaaaaggcatactaccagacagggcagttgtagcctacgcagacgaagaagattggacagtaatagatgaatcatttagattcaaatttgtactatactctaatgatctaataaaagttcaactaaagaaggacagctttttaggatatttctcaggtttagacagagccacaggggcaatatcattaagagaacacgacttagaaaaatcgaaaggaaaagatggaatgcatagaattggtgtaaaaacagctttatcatttcaaaagtatcaaatagatgaaatgggtaaggaaatccgaccatgtcgattaaagaaacgaccacccgttcgctga

SEQ ID NO: 5025 - RNA, 3246 nt, synthetic construct
  misc_feature 1..3246: note = Cas9 variant
  source 1..3246: mol_type = other RNA
atggcggcatttaaaccaaacccaataaattatatcctaggactagatataggaatagcatcagtaggatgggcaatggtagaaatagatgaagacgaaaatccgatatgtctgatagatttaggagtcagagtttttgaaagagcagaagtaccaaaaacaggtgattctctagctgcagcccgaagactggctcgttcagtaagaagacttacaaggagaagggctcataggttgctcagagctagaaggttactaaaacgagaaggagtcttacaagctgcagattttgatgaaaatggactaataaagagcttaccaaataccccatggcaattacgatcggcagcactagatagaaaattaacccctttagaatggtcagctgtactactacacctaattaaacatcgaggatatctaagtcaaaggaaaaatgaaggtgaaactgcagataaagaacttggcgcattattaaaaggcgttgcagataatgctcacgcactccaaactggagattttcgaacaccagcggaattggctctaaacaaatttgaaaaagaatcaggacatattagaaatagacgcggagattactcacacaccttttccagaaaagacctacaagcagaacttgacctattattcgaaaagcagaaagagttcggtaatccacatataagcgacgatctaaaagaaggaatagaaactttgttaatgacgcaacgaccagccttatctggtgatgcagtacagaaaatgttaggtcactgtacatttgaaccaacagaaccaaaagcagctaaaaatacttacaccgcagaaagatttgtatggttaactaagctaaataacctaaggatattagaacaaggaagcgaaagaccattaaccgacacagaaagagcaaccctcatggacgaaccctatcgtaaatcaaaactgacatatgcacaagcaagaaaacttttagaactagacgatactgcattctttaaaggattaagatatggaaaagacaatgcagaagcaagtacgttaatggaaatgaaagcataccacgcaataagtagagctttagaaaaagaaggattgaaagataagaaaagcccactaaacctaagtccagaattacaagatgaaataggaacggcgttttcactatttaaaaccgatgaagatattacagggcgtctaaaagacagggtacagccagaaatcttagaagtattattaaaacacattagttttgataaatttgtacaaatatcactgaaagcattgagaaggatagtcccattaatggaacaaggaaaaagatatgacgaagcatgcgcagaaatttacggagatcacgacggaaagaaaaatacagaagagaaaatatacctaccaccgattcccgctgatgaaataagaaacccagtagtattaagagcattgtcacaagcacgaaaagttataaacgcagtagtaagaagatatggttcaccagcaagaatacacatagaaacagctagggaagtgggaaaaagttttaaagatagaaaagaaatagagaaaagacaagaagaaaatagaaaagatagggaaaaagcagcagcgaaattccgagaatactttcctaactttgtaggagaaccaaagtccaaggacattctaaaattaagactgtacgaacaacaacatggaaaatgtctatactcaggaaaagaaataaacttaggaagattaaatgaaaaaggctatgtagaaatagatcacgcattaccattcagtcgaacttgggacgactccttcaacaataaagtgctggtcctcggaagtgaaaatcaaaacaaaggtaatcaaactccatatgaatattttaacggaaaagataactctcgagaatggcaagagttcaaagcacgagtagaaactagccgattccccagatcaaagaaacaacgtatattattacaaaaatttgatgaagaaggatttaaagaacgaaatttaaacgatactaggtatgtcaatagattcttgtgtcagttcgtagcagatcatatgttgttaactggtaaaggtaaaagacgtgtattcgcctctaacggccaaataacaaacttgttaaggggattttggggattaagaaaggttagagccgaaaacaaccgccatcatgcactagacgccgtggtagtagcatgctcaacagttgcaatgcaacagaaaataacacgcttcgtaaggtataaagaaatgaacgcgttcgatgggaaaacaattgataaagaaacgggagaagtactacaccagaaaactcattttccacaaccatgggaatttttcgctcaagaagtgatgattagagtatttggtaaacccgacgggaaacctgagttcgaagaagcagacacccccgaaaaattaagaacgctattagcggaaaaattgtcatcgagaccagaagcagtacatgagtatgtaacacctttatttgtctccagggcaccaaaccgaaaaatgagtggtcaaggacatatggaaacggtaaagagcgcaaaacgactagacgaaggtgtgtcagtcctccgagtcccactgacacaattaaaattaaaagacttagagaaaatggttaatagagaaagggaaccaaagttatatgaagcactaaaggcacgtttagaagcacataaagatgatccagcaaaagccttcgcagaacccttctataaatatgacaaagccgggaataggacacaacaggtaaaagctgtaagagtagaacaagtccagaaaactggcgtatgggtgcgaaatcacaatggaatcgcagataatgcaacgatggtccgtgttgatgtttttgaaaaagctggaaaatattacttagttccaatatactcgtggcaagtagcgaaaggcattctaccagaccgagctgttgtagcttacgcggacgaagaggggtggacagtaatagatgagagctttagattcaagttcgtgttatatagtaatgatttaataaaagtccaactaaagaaagacagttttctaggttatttttcaggtctagatcgagccacaggcgcaattagtcttcgagaacacgacttagagaaaagtaaagggaaagatggcatgcacagaattggtgtcaaaacagcactatcatttcaaaaatatcaaatagatgaaatgggaaaagaaatacgtctatgccgattaaagaaaagacccccagtaagatga

SEQ ID NO: 5026 - RNA, 3246 nt, synthetic construct
  misc_feature 1..3246: note = Cas9 variant
  source 1..3246: mol_type = other RNA
atgaccgcattcaaacctaatcccattaattacatactgggcttagacataggtatagcctcagtaggttgggcaatggttgaaattgatgaagaagaaaacccgattaggcttatagacttaggagtaagagtattcgaacgagccgaagtcccaaaaacaggagacagtctagccgcagccagacgactagcaagaagcgtcagaaggttgacaagacgcagagctcacagactattaagagccaggagattgttaaaaagggaaggcgttctccaagcagctgacttcgacgaaaatggtttaattaaatctcttcctaatacaccttggcaactaagagccgctgcattggatagaaaactcactcctcttgaatggagtgctgtcctgttacatctaataaaacatcgaggttacttaagccaaagaaaaaatgaaggagaaacggcagataaagaactaggcgcgcttcttaaaggagtagcagataatgcccatgcgctacaaacaggagatttcagaacgcctgccgaactagcagtcaacaaatttgaaaaagaatctggccatattagaaaccaaagaggcgattactcccacacattttcgcgaaaagatttacaagcagaattagtattattatttgaaaaacaaaaagaatttggcaacccacatatatctgacggcctgaaagaaggaatagaaacactcttaatggcacaacgaccagcactaagcggagatgcggtccaaaaaatgttaggttactgtaccttcgaacccacagaacccaaagcggcaaaaaatacctatactgccgaaagatttatatggttgacgaagctaaataacctacgaatcctagaacaaggttcagaaagaccacttacagatacagaacgagcaacattaatagatatgccatacaaaaataaattaacttacgcaaaagcacgtgaactactaggtttagatgacacagcttttttcaaaggtcttcggtatggcaaagataacgcagaaagcgctaccctcatggaaatgaaagcatatcacgcaataagacgtgcactagaaaaagaaggtctaaaagataaaaaaagtccattatctctatcaccagaactacaagatgagatcggaacagcatttagcttatttaaaacggacgaagacataacgggaagattaaaaggatgtttacaaccagagattctagacgcattacttaaacatataaattttgacaaattcgttcaaatttcactaaaagcattaagacgaatagtaccattaatggaacagggaaaaaggtatgacgaagcatgcgctgaaacctatggggaccactacggtgaaaaaaattcagaagagatgctatacttaccacccataccagcagatgaaatcagaaacccagtagtcttacgagcattatctcaagcaagaaaagtaattaatggagtggtacgaagatacggatcaccagcaagaattcatattgaaacagcacgcgaagtaggtaaaagtttcaaagatagaaaagaaatagaaaaaagacaagaagaaaatagaaaagatagggaaaaagcagcggcaaaatttagggaatatttcccgaatttcgtcggtgaaccaaaatcaaaagatatattaaaacttagattatacgagcaacaacacggcaaatgtttatactcaggcaaagcaatcgatattagacgattaaacggaaaaggatatgtagaaatagatcatgcccttcctttttctagaacgtgggatgattcttttaataataaagtactcgttctaggatctgaaaaccaaaacaaaggaaacagaacaccatacgaatatcttaacggaaaagacaactcaagagaatggttagaatttaaagcaagagttgaaactagcagatttcctcatagtaaaaaacaaagagttttactacaaaaattcgacgaaaaaggttttaaagaaaggaatctcaatgacaccagatacgtgaacaggtttttatgccaatttgtagctgaccatatgcaactaacaggtaaagggaaacgaagagtgttcgctagtaacggacaaataacaaatctattaagaggcttctggggactgcataaggtaagagcggaaaacgacagacatcatgctttagacgcagtagtagtagcatgctctacagtagccatgcaacaaaaaataacatgttttgtgagatataaagaaatgaacgcattcgatggaaaaactgtagacaaggaaacaggtgaagtattgcatcaaaagacccacttcccacaaccttgggaattcttcgcacaagaagtcatgataagagtctttggaaaaccagatggaaaaccggaattcgaagaagcagatacacccgaaaaacttagagcgctactagcagaaaaactatcaagcagaccagaggctgtacatgaatacgttacgccactattcgtatcaagagcaccaaatagaaaaatgtctggagctcataaagatacgctacgttcagcaaaaaggttcgtaaagcataatgaaaaaataagtgtaaaacgggtctggcttacagaaataaaattagcagatctagaaaatatggtaaattacaaaaatggacgagagatagaattatatgaagccctcaaagcaaggctaggggcatacggaggaaatgccaaacaagccttcgatccgaaagataaccctttctacaaaaaaggaggccaactagttaaagcggtaagagtagaaaaaacacaagaatctggcgtattactaaataagaaaaacgcatacacaattgcagacaacggagacatggtaagagtcgacgtcttttgcaaagtagataaaaaaggaaaaaatcaatattttattgtaccgatatatgcatggcaagtagcagaaaacatcttacctgacattgattgcaaaggttatcgaatagatgatagttatacattttgtttcagtctgcataaatatgatctaatagcttttcagaaagatgaaaaatctaaagtagaatttgcgtattatataaattgtgattcctcaaacggacgtttctatttagcatggcatgacaaaggatcaaaagaacaacaattcagaataagcacacaaaatctagtattaatgcaaaaataccaaatagatgagttaggaaaagaaatcagaccatgtcgactcaaaaaaagaccaccggtcagatga

SEQ ID NO: 5027 - RNA, 3246 nt, synthetic construct
  misc_feature 1..3246: note = Cas9 variant
  source 1..3246: mol_type = other RNA
atggcggcgttcaaaccaaaccccataaactacatattaggactcgatatcggcattgcaagcgtcggatgggcaatggtcgaaatagatgaagacgaaaatccaatatgtcttatcgatcttggagtacgtgtatttgaacgtgctgaagtacctaaaaccggagacagtttggcagcggctcggcgtttagctaggtcggtaagaagactaacacgaagaagggcacatcgtctactaagggcaagaagactactcaaaagagaaggcgtacttcaagcagctgatttcgacgaaaacggattaataaaatctctcccaaacacaccatggcaattaaggagtgcggctttagatagaaaattaaccccactggaatggagtgctgtactcttacacctgataaaacatagaggatatcttagccaacgcaaaaatgaaggtgagacagctgacaaggaattgggcgccttgttaaaaggggtagctaacaacgcgcacgcattacaaacaggcgatttcaggactccagctgaattagcgttaaacaaattcgaaaaagaaagtggacatataaggaatcaaaggggcgattattctcacacttttagtagaaaagacttacaagccgagctaatcttattattcgaaaaacaaaaagagttcggaaacccccatgtttccgggggtctaaaagaaggaatagaaactttactaatgacacaaagacctgcactttcgggcgatgcagttcaaaagatgctcggacactgcacatttgaaccagcagaaccaaaagctgctaaaaatacatacaccgccgaaagatttatatggctcactaaattaaataacttacgcattttagaacaaggaagtgaaaggccactaacagatacagaacgcgcaaccttaatggatgaaccatatcgcaaatccaaactaacatacgcacaggctcgcaaattactaggcctagaagatacagctttctttaaaggactgaggtacggaaaagacaatgcagaggcttcaactcttatggaaatgaaagcatatcacgcgatctcaagagctctcgaaaaagaaggacttaaagataagaaaagtcccttaaatttatcaccagaactacaagatgaaattggaacagccttttcattattcaaaaccgatgaagatataacaggaagattaaaagatagaatacaaccagaaattctcgaagccttattaaaacatatctccttcgataaatttgttcaaatatcgctaaaagcacttcgacgaatagtaccactaatggaacaggggaaaagatatgatgaggcttgcgcagaaatatatggagatcattacggaaagaaaaacaccgaagagaaaatatacttacctccaatcccagctgatgaaatccgaaaccccgtcgtactgagagctttaagtcaagcaagaaaggtaattaatggcgtagtaagaagatatggaagccccgcaagaatacatatagaaacagcgagagaagtcggaaaaagtttcaaagacagaaaagaaattgaaaagaggcaagaagaaaatagaaaggacagggaaaaagcagcagccaaatttagagaatattttccaaattttgtaggagaaccaaaaagcaaggacatcttaaaactacgattgtatgaacaacaacatggcaaatgtttatattcaggcaaagaaataaacctaggtagattaaacgaaaaagggtatgtagagatagatcatgcattacccttctccaggacatgggatgatagtttcaataataaagtattagtactaggaagcgaaaatcagaacaaaggtaatcaaacaccttatgaatacttcaacggtaaagacaactcacgagaatggcaagaatttaaagcacgtgtagaaactagcagatttccgcgatctaagaaacaaagaatattattgcaaaaattcgacgaagacggatttaaagaaagaaatctaaacgatacaaggtatgtaaaccgattcctatgtcaattcgttgcagatagaatgagacttacaggcaaaggaaagaaacgagtgtttgcatctaatggacaaatcacaaatctcttaagaggattttggggactaaggaaagtacgcgcagagaatgatagacaccatgcattagacgcagtagtagtcgcatgctccacagtagcaatgcaacagaaaataacaagattcgttagatacaaagaaatgaatgcctttgatggtaaaacaattgataaagaaacgggagaagtattacaccagaaaacgcactttccacaaccctgggagttcttcgcccaagaagtaatgatacgagtcttcggaaaacctgatggaaaacccgaatttgaagaagctgatacaccagaaaaattaagaacactgttagctgaaaaattatcaagcagaccagaagcagtacacgaatatgtcactcccctcttcgtcagtagagcgcctaacagaaaaatgagtggacaaggacacatggaaactgttaaaagtgccaaacgtctagatgaaggagtatcagttttaagagtaccactaacacaactcaaactaaaagatctcgagaaaatggtaaacagagaaagagaacctaaactttatgaggcactcaaagccagactcgaagcacataaagacgatccagcaaaagcattcgcagaaccattctataaatatgataaagctggtaacaggacccaacaagtgaaagccgtacgagttgaacaagtccagaaaacaggagtttgggtaagaaaccataatggaatagctgacaatgcaacgatggtcagagtagacgtctttgagaaagcaggaaagtattacctagtaccaatatattcctggcaagtagctaaaggaatattaccagatagagccgtagtagcatatgcagatgaggaaggttggacagtcatagacgaatcatttagattcaaatttgtgttatacagtaatgatttaatcaaagtacaactcaagaaagattcattcctcggttatttctcagggctagatagagcgacaggggcaatctcactaagggaacatgatttagaaaaatcaaaaggaaaagacggcatgcatagaatcggagttaagactgcactatccttccaaaaataccaaatcgacgaaatgggaaaagaaatacgtttatgcagattaaagaaaaggccacccgtacgttga

SEQ ID NO: 5028 - RNA, 3246 nt, synthetic construct
  misc_feature 1..3246: note = Cas9 variant
  source 1..3246: mol_type = other RNA
atgctaaaaagagttttaggaatagatgtcggaatatccagcataggatgggcactcctcgaatttcaaggagacatagacaacaaagatctaccttccggaaaaatcttggcatcaggggtaagagtttttactcaagcagaaaacccgaaaaacggcgagtcacttgcgaaaccacgacgagatgcaagattggcacgaagaagaaccagaagacgagcacagaggctaacagatataaaagatttattcttcaaatataaactcgtcaccgggataagcagaaataaaattaatagtatatacaaaaccgaagaaaataaaaaagacccttggactttaagaaaagaagctttatacagaaaactagacggagaagagtttgcaagagtgttaactcacatagcaaaacacagagggttcaagtctatgagaaaaagcgaagaagaaggcagcgacacaaaagctaaagaaacgcaaagagttttaacagaaataggaaaaaacaaagacacactaaagacaggcatatggcaaacagccggagagatgattgcaagcaggccaaaaggagacgccagacgaaacaaaactgactcatataaaaatagcatatcgagggagctactacaagatgagacaaagataatattcgaaaaacaaagaggaatgaattcacaattcacgtcagcagatctagaaaaagaatacagcgatatagccttccaccaagcaccaatacaatcaatgctcaaaatggtcgggggatgtacttttgaaaaggatgaagaaggtaaacgattaaaacgagccccaaaaaactcatattccgcagaagttttcaccgctttaactaaaataaataacctagtacttaaaactaaaactgccaacatcaacgaccgcttccttactacagaggaaagaaaaaaggcactagaactgtgccattcaaatgcaaaagtaacattcaaacagcttagaggtgaattagggctaccagaagactggatcttcaacacagtagactatgcaaagaaaccgaaaaaaaccgccgtcaaagaaaccgaacccgaatctgcttgcttcttccagatgagaggatataatgaaataagaaaaagcgtgggaaaggacttgtggaccgaaataagcatgaaaaaagaaatactaaatagtatagttacaacactagcaacagaaaaaagtgacgaagccatcaaggctcaattaaaaaaaagtgaagtcccggatgaaattgccgaaaaagtactaggacttaacttcagaggttttctgcacctaagtataaaagctctggacaagataattccgttcatgatggcaggtgacaaatacacagacgcatgtgataaagcaggttacaaggaacaaattagtggcataaagaaaatatttctcagaaaactaaacgatgaagaaaacgaacaaataacaaaccccgtagccaagagagctatcacacagtttagaaaagtaattaacgcgataataagagaatacgggaaatttgaccaaatgaatatagaattagctagagatctagcaaaatcatacgacgacaggaaaaaaatcaaagaaggacaagaagatttcagagctgaaaaagaccgagccgcccaaaggtgtaaagataatggcttagatccaaatagtaaagacaacttaagtaaataccggctatgggaacagcaggacaacggattctgtatttactgtggcaaaccaatagaactacagagactggctgaacaaggttactgtgaagtagatcatatactaccctacagccgaagcttagatgactcacaacacaacaaagtactagcccacatacatgataatcaacaaaaaaaaaatcaaatcccttttgaacactttggaggagatggaccaaaatgggaagaattcgtaggaagactaaacagtcaattcaaaaacttaccaaaatcaaaactaaatagattagtgaaaagaaaattcgacgaaaaagacatggaaggcttcaaagaaagaaacatcaatgacacacgatatatatcaagattcataaaaaattttgtcgagaaccacttagaattcgctgaaagcgcacaaaaacaaaaagtattcgtacgaagcgggtctttaacagcatttctgagacatcaatggggtttgataaaaaaaagagacgaatcagatcgccaccacgcactagatgcactcgtaactgcatgtgcaacacaagccatggtaaaatctactgcaataacagctcaaaaaatggaaagttataattggataaataaagaaaaacctagaatgccactaccatggctgaactttcgagacgacgtacaaaaaagcctggatgccgtattcgtaagccgagctccacgacacaaagtaggaggcgctgcacacaaagaaaccataagatccataagaaaatgcggcgaagaaaatctaataatcgaaaaaacccccttagtagatattgcaacgaaatcaggaatcaaactcaaagacattgaaaaactatataaaaaagaacagaatagaaaactctacgaaacattaaaggaaagattagagcaaaatggaaacgaccctgttaaagcatttggaaaccccgatgacccagttcgtatgccaaccaatgatctaacaaaaacgggaccaattataaaatcaataaaactaataacgaataaaaaaagcggattaaacgtaagagcaggaatagctgacaatggcgaaatagcaaggctagacgtttacgaaagaaaaggaaagttctacctcataccgaattatgtagctgatttcgcaaacaaagaattacctaaaaaggccatcaaagcgaatacaccagaaacagaatggccaataatagacagaaactacaattttaaattctcgctgttcaaagatgatctgataagtataaaacaaaaattagacagtccagaagagttctattattataaaggacccgacgtgtcaacggcatctataactgtagaaagcgtcgatagaaaacggctatgggaagaaaaaaaaaaaggaaaaattgaaaacgtctttcatacccgaatcgggacaaagacactaaaaagttttagaaaatttaacttagatatattaggcactaaagcaccagtagaaatcaaaaaagaaacatgggttggagtaatacggaaaaacggagtcgcaaacaacacaggtaacaaagcaatgtga

SEQ ID NO: 5029 - RNA, 3249 nt, synthetic construct
  misc_feature 1..3249: note = Cas9 variant
  source 1..3249: mol_type = other RNA
atggccgcctttaaaccaaatccgatgaactatatattaggacttgatataggaatagcgagtgtaggatgggctatggttgaaatagacaaagaagaaaacccaataagattaatagatctaggagtgcgcgtttttgaaagggcggaagtaccaaaaacaggagattcacttgcaatggccaggagacttgcaagaagtgtaagaagactaactagaaggcgagctcatagactacttagggcaagaagattacttaaaagagaaggggtattacaagatgcagattttgacgaaaacggactcgtgaaaagtctaccgaatactccatggcaattaagagctgccgcattagatcgaaaactcacttgtttagaatggagtgccgtactactacatctaataaaacacagaggctacttaagtcaaaggaaaaatgaaggagaaactgcagataaagaattaggtgcgctattgaaaggcgtcgctgataatgcacatgccctgcaaactggagactttagaacacccgcagaactagcacttaacaaattcgaaaaagagagtggtcatatcagaaaccaaagaggagactattcacacactttctcaagaaaagacttacaagcagaactaaatttattattcgaaaaacaaaaagaatttagtaatccacatgtatcagattcactaaaagaaggaatagaaacactattaatggcacaacgcccagcgttaagcggggatgcggtacagaaaatgctaggtcattgcacatttgaaccagcagagccaaaggcagccaaaaatacatatactgcagaaagattcatatggttaactaaactaaataacttaagaattttggagcagggatccgaaaggccattaacagacacggaaagagcaacattaatggatgaaccatatcgtaaaagcaaattaacatatgcacaagcaagaaaactattaggattagaagacacagcatttttcaaaggtttaaggtacggtaaagataacgcagaagcaccaacattaatggaaatgaaagcctaccacgcgatctcaagggcattagaaaaagaaggcctcaaagataagaaatctccattaaatctgtcaacagaactacaagatgaaataggtacagcattctccttgtttaaaacagataaagacataacaggacgactaaaagacagagtacaaccagaaatactagaagccctactaaaacatatatcattcgacaaatttgtacagatttctttgaaagcactcagacgtatcgtacctctaatggaacaaggaaaaagatacgatgaagcctgtgccgaaatatatggagatcactattgcaagaagaatgcagaggagaaaatatatttacctccaatacctgcagatgaaattaggaacccagtcgtactaagagcgctgagtcaggctaggaaagtaataaattgcgtagtacgaagatatggatccccagctagaatccacatagaaacggcccgtgaagtaggtaaaagttttaaagaccgaaaagaaatagagaaaagacaggaagaaaaccgcaaagaccgggaaaaagcagccgcgaaatttcgagaatattttccgaactttgtaggagaaccaaaaagtaaagatatattaaaacttcgtttgtacgaacaacaacatggcaaatgtctatattcaggtaaagaaatcaaccttgtccgattaaatgaaaaaggttacgtagaaatagaccacgcactaccattcagtagaacctgggacgacagtttcaacaataaagtactcgtcttaggatcagaaaatcaaaataaaggtaatcaaacaccttacgaatacttcaacgggaaagataattcacgagaatggcaagagttcaaagcaagagttgaaacttcacgatttccgcgatcaaagaaacagaggatattattacaaaaattcgatgaagaaggattcaaagaacgcaacttaaacgataccagatatgttaatagatttctttgtcaattcgtggcagaccatattctattaactggcaagggtaaacgaagggttttcgcaagtaatggccaaataacgaatctacttagaggcttttggggtttaagaaaagtaagggctgaaaacgacagacatcatgccctagatgccgttgtagtagcttgtagtacggtggcaatgcaacagaaaataactagatttgttcgttataaggaaatgaatgctttcgatggaaaaacaatagacaaagaaacaggagaagtgttacatcaaaaagcacactttccacaaccgtgggagttctttgcacaggaagtaatgatccgggtatttggaaagcccgatggaaagccagaatttgaagaagcagatacaccagaaaaattaagaacattattggcagaaaaactatcaagtagacccgaagcggtccacgagtacgtaacaccattattcgtgtcaagagccccaaatagaaaaatgagcggacaagggcatatggaaacagtaaaaagtgcgaagaggttagacgaaggtataagcgttcttagagtccccttaacacaactaaaactaaagggacttgaaaagatggtaaaccgagaaagagaaccaaaactatatgacgcactaaaagcccaattagagacacacaaagataaccccgctaaggcttttgcagaacctttttataaatacgataaagctggcaataggacacaacaggtaaaagcggttagaatagaacaagtccagaaaaccggtgtatgggttcgcaatcataatggcattgcagacaacgctaccatggtacgggtagacgttttcgaaaaagggggcaaatattacctagtaccaatatatagctggcaagtagctaaaggaatattaccagatcgagcagttgtcgcatttaaagacgaagaagactggaccgtaatggacgattcgttcgagttcagatttgttctatatgcaaatgacttaatcaaattaacagcaaagaaaaacgaatttctcggttacttcgtatcattaaacagagcaaccggagctatagatatacgaacacatgatacagacagtacaaaaggtaaaaatggaatcttccaatccgtaggcgtaaaaacagcactctcattccagaaaaatcaaattgatgaattgggaaaagaaattagaccatgtagattaaagaaacgacccccagtaagatga

SEQ ID NO: 5030 - RNA, 3249 nt, synthetic construct
  misc_feature 1..3249: note = Cas9 variant
  source 1..3249: mol_type = other RNA
atggcagctttcaagcctaacccaattaactatatattagggcttgatataggaatcgcaagtgtaggttgggcaatggtagaaatagatgaagaagaaaatccaatcagattaatcgatctaggtgtaagagtattcgaacgtgcggaggtgcctaaaactggagatagtcttgctatggcacgacgtctagcaagatcagtacgaaggctcacacgaaggagagctcatagactcttaagagcgagaagactattaaaacgagaaggcgttctgcaagcagcagactttgatgaaaatggccttataaaaagcctacccaataccccgtggcaactgagagcagcggccctagacagaaaacttacgcccttagaatggtcagccgtgctactacatctaattaaacatagaggttacttaagtcaacgcaaaaacgaaggagaaacagcagacaaagaactaggagcattactaaaaggagtggcaaacaatgcacatgccttacaaactggtgactttagaactcctgctgaattagcattaaataaatttgaaaaagaatctggacacataagaaaccaaagaggagactatagtcatacattttcaagaaaggacttgcaagcggaattaatattattatttgaaaagcaaaaagagttcggaaacccacatgtgagtggcggcctcaaagaaggaatagaaacattattaatgacacaaagacctgctctttcaggcgacgcggtccaaaagatgcttggacactgtacatttgaaccagcagagccaaaagctgccaaaaacacttacactgctgaaagattcatatggttgacgaaactcaataatttacgaatactagaacaaggaagtgaaaggcccttaacagatacagagagagctacgttaatggatgaaccgtatagaaaatcaaaactaacgtacgcacaagcaagaaaattattaggattagaggataccgcctttttcaaaggactaagatacggaaaagataatgccgaagcatcgacactcatggaaatgaaagcatatcatgcaatatcacgtgcattagaaaaagaaggattaaaagataagaaaagccctctcaacctcagcagtgaactacaagacgaaataggaacagcatttagcttattcaaaacagatgaagatataacgggaagactgaaagatcgcgtacaacccgaaattttagaagccttattaaaacacattagcttcgataaattcgtccaaatctcactaaaagcactcagaagaatcgtgccactaatggaacaaggtaagagatatgatgaggcttgtgcagaaatatacggtgatcattacggtaagaaaaacactgaagagaaaatatacttgccacctatacctgcagatgaaataagaaatcctgttgttcttagggcattatcacaagcacgaaaagttataaatggtgtagtgcgcagatatggatccccagctagaatccatattgaaacagcaagagaagtaggcaagagctttaaagatagaaaagaaattgaaaaacgacaagaagaaaatagaaaagacagggaaaaagcagccgccaaattcagagagtactttccaaattttgtaggggaaccaaaatcgaaagacatcttaaagttacgactttacgaacaacaacatggaaaatgtttatactcgggaaaagaaataaatttagtaagattaaacgaaaaaggatacgtagaaatagatcacgcactaccattttcaagaacctgggacgacagttttaacaataaagtattagtattaggcagtgaaaaccaaaacaaaggaaaccaaaccccctacgaatactttaatggaaaagataatagtagagaatggcaagaatttaaagcaagggtagaaaccagtcgatttcccagatctaagaaacaaagaatcctactacaaaaatttgatgaagacggatttaaagaatgcaatctaaatgacacccgttatgttaacagattcttatgtcaattcgtagcagatcacatattactcacaggaaaaggaaaaagacgagtattcgcatcaaatggccaaataaccaatctacttcgtggcttttggggacttagaaaggttagagctgagaacgacagacatcatgcgcttgacgccgtagtagtagcctgctcgacagttgcaatgcaacagaaaatcactagatttgtaagatataaagagatgaatgcatttgatggcaagacaattgacaaagagacaggaaaagtattgcatcaaaagacacatttccctcaaccgtgggagttcttcgcacaagaagtaatgatacgagtattcggaaaaccagacggaaaaccagaatttgaagaggctgacacaccagaaaaactcagaacattacttgcagaaaaactgagctcaagaccagaagcagtacacgaatacgtcacgcccctatttgtaagcagggctccaaaccgtaaaatgtcaggccaagggcatatggaaactgtaaaatcagcaaaacgattagatgaaggtgtctccgtcttacgagttccattaacacaattaaaactaaaagatttagagaaaatggtcaatagagaacgagaaccaaaactatatgaagcactaaaagcccgtttagaagctcataaagacgatccagcaaaagcattcgctgaaccattctacaaatatgataaggcaggaaaccgcacacaacaagtaaaagctgtaagagtagaacaagtacagaaaacaggagtttgggtacgaaatcacaacggaattgcagataatgcaacaatggtgagggtagatgtattcgaaaaaggcgataaatactatttggtccctatttacagttggcaagtagctaaaggaatattaccagaccgagcagtagtacaaggaaaagatgaagaagactggcaactaattgatgatagctttaattttaaattttctctgcatccaaacgatctagtagaagttataacgaagaaagcaagaatgtttggatatttcgcaagttgtcatcggggcaccggaaacataaatatacgtattcatgatttagatcataaaataggaaagaacggcattctagaaggaatcggagtcaaaaccgcactaagtttccaaaaatatcaaatagatgagttggggaaagaaataagaccatgcagacttaaaaagaggcctcctgtaagatga

SEQ ID NO: 5031 - RNA, 3249 nt, synthetic construct
  misc_feature 1..3249: note = Cas9 variant
  source 1..3249: mol_type = other RNA
atggcagcattcaaacccaacccgatcaattacatattaggcttagatatcggaatagcgagtgtaggctgggctatggttgaaattgacgaagatgaaaacccaatatgtttgatcgacctaggtgtacgcgtgttcgaacgagcagaagtgcctaagactggggatagtcttgctatggcaagacgtttagcaaggtcagtaagacgattaacacgacggagagcacatagattactaagagcaagacgattactgaagcgcgaaggagtgctacaagctgctgattttgatgaaaatggattaattaagagcttacctaacacaccgtggcaattacgagcagctgctcttgatagaaaactcactcctttagaatggagcgctgtactattacacttaattaaacatagaggttaccttagccaaaggaaaaatgaaggagaaactgctgataaagaacttggagcacttctcaaaggagtcgctgataatgcgcatgcactccaaactggagattttcgaacccctgcagaactcgctttaaacaagtttgaaaaagaatcaggacatataagaaatcaaagaggagattatagtcacacattctctcgaaaagatttacaagcagaattaatactattatttgagaaacagaaagaatttggaaatccgcatgtcagcggcggattaaaagaagggatagaaactctcttaatgacacagagacctgcactaagtggagatgctgtacagaaaatgctaggacattgtacatttgaaccagcagaaccgaaagcagctaaaaacacatatacagcagaaagatttatttggctcactaaattaaacaatcttaggatactcgaacaaggatcagaaagaccactaacagacactgaacgtgctacattaatggatgagccatacagaaaatcaaaattgacatatgcacaagcacgaaaactacttggtctggaagacacagcattcttcaaaggacttagatatggcaaggataacgcagaagcatctaccctaatggaaatgaaggcttaccacgcaatctctagagcattagagaaagaaggactaaaagataagaaaagtccattgaatctaagtccggaacttcaagatgaaataggtacagccttcagtttattcaaaaccgatgaagatataaccggaaggctaaaagacagaatacagccggaaatactggaggctttactaaaacacatcagctttgataaattcgtacaaattagcttaaaagccttaagaagaatagttccacttatggaacaaggcaaaagatatgacgaggcttgtgcagaaatctatggagaccactatggaaagaaaaataccgaagagaaaatatatttaccaccaataccagctgacgaaatccgaaacccagtagtactaagagcacttagtcaagctcgtaaagtaattaatggagtcgttcgacgatatggcagtcccgcacgaatacacattgaaacagcccgcgaagtcggcaaatcgtttaaagatcgaaaagaaattgagaaaagacaagaagaaaatagaaaagacagagaaaaagcggcagcgaaatttcgagaatattttcctaattttgtgggagaacccaaatctaaagatatcttaaaattaagattatacgaacaacagcacgggaaatgtttatatagtgggaaagaaataaacttaggtagactaaatgaaaaaggatatgtagaaattgatcatgctctaccattcagccgaacatgggatgattcattcaacaataaagttcttgtattaggaagcgaaaaccagaataaaggcaatcaaacaccatatgaatactttaacgggaaagataattcaagagaatggcaggagttcaaagcacgagtagaaacaagcagatttccgagaagtaagaaacaaagaatactattgcaaaaatttgacgaagatggattcaaagaaagaaatctaaatgatacgagatatgtcaaccgatttttatgtcaattcgttgcagatcgtatgaggcttaccggaaaagggaagaaaagagtttttgcgtcaaatggacaaataaccaatctgttaagagggttctggggattgaggaaagtcagagccgaaaatgacagacatcacgcactagacgcagttgttgtagcttgctcgacagtagccatgcaacaaaagataacaagatttgtaagatataaagaaatgaacgcatttgatggcaaaacaattgataaagaaacaggtgaagtactacatcagaaaacacactttcctcaaccatgggaatttttcgcacaggaagtaatgataagagtatttggaaaaccggatggtaaaccagaatttgaagaagcagacacaccagaaaaattaagaacattactggctgagaaattatcatcacgaccagaagctgttcacgaatacgtaacaccactgtttgtaagcagagcaccaaacagaaaaatgagtggtcaaggacatatggaaactgttaaatctgcaaaaaggttagatgaaggagtttccgtcctacgagttccactgactcaactaaaactaaaagacctagagaaaatggtcaaccgcgaaagagaacccaaattatatgaagcactaaaagcaaggttagaagcacacaaagatgatccagccaaggcttttgcagaaccattttataaatacgataaagcaggaaatagaacacaacaagtaaaagcagtaagagtggaacaggtacagaaaacaggagtatgggtacgcaaccataacggaatagcagataacgcaacaatggtaagagtagatgtattcgaaaaaggtgacaaatactatttagttccaatctacagttggcaagttgccaaaggaattttacctgatagagctgtagtacaaggaaaagacgaagaagattggcaactgattgatgatagctttaacttcaaattttcattacatccgaatgacctagtagaagttatcacaaagaaagcaagaatgttcggttattttgcatcatgtcacagaggtacagggaatataaacatacgaatacatgacctggatcataaaattggcaaaaatgggattctagaagggataggagtcaaaacagcattaagttttcaaaaatatcaaatagacgaactaggagaagaaattagaccctgcagactgaaaaagagaccacccgtaaggtga

SEQ ID NO: 5032 - RNA, 3249 nt, synthetic construct
  misc_feature 1..3249: note = Cas9 variant
  source 1..3249: mol_type = other RNA
atggcagcatttaaaccaaaccctataaattatatattaggtctagacataggcattgcttctgtagggtgggcaatggtagaaattgatgaagatgaaaacccaatatgcttaattgatttaggagtaagggtatttgaaagagctgaagtcccaaaaactggcgattccctagcaatggccagaagactggcccgatcagttagaagattaactagacggagagcacacagattgttaagagcaagaaggctccttaaaagagaaggagtactacaagcggcagattttgacgaaaacggactaatcaaatcattacccaacacaccatggcaattacgagctgcagccctcgatcgtaaattaacaccattagaatggagcgctgtcttactgcatcttataaaacatagaggatacctcagtcaaaggaaaaatgaaggagaaacggcagacaaagaactgggagctttactcaaaggagtagctgacaatgctcatgcattacaaacaggagacttccgaacccctgcagaacttgcattaaataaattcgaaaaagaaagtggacacataagaaaccaaagaggggactatagccacactttttcacgaaaagatttacaagccgaactaatattactatttgaaaaacaaaaagagttcggaaacccacatgtttcaggtggcttaaaagaaggaatagaaacactcttaatgacacaaagaccggcactatcaggtgatgcagtccagaaaatgttagggcattgtacatttgaaccagctgaacctaaagcagccaaaaatacttacacggcagaaagattcatatggcttacaaaattaaacaatcttagaatactagaacaagggagcgaaagaccattaactgatacagaacgagctacgctcatggatgaaccatacagaaagtcaaaattgacgtacgcacaagcgaggaaactgttagggctagaagatactgcatttttcaagggattacgatatggcaaagacaatgctgaagcatcaaccctaatggaaatgaaagcatatcatgctatctctcgagcattagaaaaggaaggacttaaagataagaaatctccccttaatttgtcacccgaacttcaggatgagataggtactgcgtttagcctatttaaaactgatgaagatataacaggacgattaaaagacaggattcaaccagaaatcttggaagcattacttaaacatataagtttcgacaaattcgtgcaaatatcacttaaagcactaagaagaatagtgccattaatggaacaagggaaaagatacgacgaggcatgtgcagaaatatatggagaccactacggaaagaaaaacacagaagagaaaatttacttaccgccaattcccgcagacgaaataagaaacccagttgtattaagagcactgtcacaagcaagaaaagtcatcaatggagtagtccgtagatacggaagtcctgcaagaatacatattgaaacagcaagagaagtcggaaaatctttcaaagatagaaaagaaatcgaaaaacgacaagaagaaaatagaaaagacagagaaaaggcagcagcaaaatttcgagaatatttcccaaattttgtaggagaaccgaaaagcaaagacatcttaaaattaagactgtatgaacagcaacatggaaaatgtctatactctggtaaagaaatcaatttaggtcgattaaatgaaaaaggatacgtcgaaatagatcatgcactaccatttagcagaacatgggacgactcattcaataataaagtattagtcttaggtagcgaaaaccaaaataaaggaaaccaaactccgtatgaatacttcaatggaaaagataatagcagagaatggcaagaatttaaagcacgagttgaaacaagcagattcccaaggagcaagaaacaaagaatcttattacaaaaatttgacgaagatggttttaaggaacgaaatttaaacgacacaagatacgtgaacagattcctatgccaatttgtagcagatcgcatgaggttaactgggaaaggaaagaaacgagtatttgcatctaacggacaaatcactaatttattaagaggattttggggtctaaggaaagtaagagcagagaacgatagacaccacgcgcttgatgcagtagtagtagcatgcagcacagtcgcaatgcaacagaaaattaccagatttgtaagatataaagaaatgaatgcgttcgatggaaaaactatagataaagaaacaggagaggtactccatcagaaaacacatttcccacaaccatgggagttcttcgcacaagaagtaatgataagagtattcggaaaaccagatggtaaaccagaatttgaagaagccgacaccccagaaaaacttagaacattacttgccgaaaaattaagtagtagacctgaagccgtacatgaatatgtaacgcctttatttgtctccagagcgccaaataggaaaatgtcaggacaaggacatatggaaacagtcaaatctgcaaaaagacttgatgaaggagtatcagtattgcgagtgccgttaacacaactaaaattaaaagatctagagaaaatggttaatcgtgaacgcgaaccaaaactatatgaagccctaaaagcaagacttgaagcacacaaagatgatcctgcaaaagcattcgcagaacctttctacaaatatgacaaagcaggaaatcgaactcaacaagtaaaggctgtcagagtggaacaagtgcagaaaacaggagtttgggtaaggaatcataacggaatagcagataacgccacaatggtaagagtagacgtattcgaaaaaggagacaaatactacctagtacctatatactcatggcaagtagccaagggaatactaccagatcgcgcagttgtccaaggaaaagacgaagaagattggcaacttattgacgacagttttaattttaaatttagtttgcatccaaatgatcttgttgaagtaatcacaaagaaagccagaatgtttggttacttcgccagctgtcacagaggcacaggtaatataaatataaggattcacgatcttgatcacaaaattgggaaaaatggaatattagaaggaataggagtaaaaaccgccctaagtttccaaaagtaccaaatcgacgaattaggaaaagaaataagaccttgtagattaaagaaaagaccgcccgtaagatga

SEQ ID NO: 5033 - RNA, 3249 nt, synthetic construct
  misc_feature 1..3249: note = Cas9 variant
  source 1..3249: mol_type = other RNA
atggcagcatttaaaccaaatccaattaattatatattaggattggatataggaatagcaagtgtcgggtgggctatggtggaaattgatgaagacgaaaatcctatatgtttgatagatcttggagtacgagtatttgaaagagctgaagtccctaaaacgggtgactcactagcagcagcgaggcgtctcgcaagatcagtaagaagattaacacgaagacgagcgcacagacttttacgagcccgacgccttctaaaaagagaaggtgtacttcaagcagcggactttgatgaaaatggcttaataaaatcgttgcctaacactccatggcaactcagggcagcagctctagacagaaaactcacaccactagaatggtccgctgtattactacatctaataaaacaccgaggatatttaagtcaaaggaaaaatgagggtgaaaccgcagacaaagaactaggagcattacttaaaggtgtagcagataatgctcacgcactacaaacaggtgacttcagaactccagcagaactagcactaaataaatttgaaaaagagagtggtcatataagaaatcaaagaggtgattattcacacacatttagtaggaaagacctacaagcagaattaatactactatttgaaaaacaaaaagagttcgggaatccacatgtaagcggcggtttaaaagaaggaatagaaactcttcttatgacacaacgaccagctctcagtggggacgcagtccagaaaatgcttggtcattgcacttttgaaccagctgaacccaaagcggctaaaaatacttacacagcagaaagattcatatggttaacaaaactaaataatctacgaatcctcgaacaaggcagcgaacggcctttaacagatacagaacgagcgaccttaatggatgaaccttatagaaaaagcaaattaacatacgcacaagcaagaaaattactcggcttagaagacacagcgttctttaaagggttaagatacggaaaagataatgcagaagcgtcaacacttatggaaatgaaagcataccacgcaatatcaagagcgttagaaaaagaaggacttaaagataagaaatcaccactaaatttgtcaccagaattacaagatgaaataggaactgccttcagtttatttaaaaccgatgaagatataacgggaagattaaaagatagggtgcaacccgaaatattagaagccttattgaagcatatatcatttgacaaatttgtacaaatatcattaaaagccttaagaagaattgtaccgttaatggaacaaggaaaaagatatgatgaggcttgcgctgaaatatacggtgatcactacggcaaaaagaatacggaagaaaagatatatttaccaccaataccggcagacgaaattagaaacccagttgttctcagagcactatcacaagcaagaaaagtaataaatggagtagtaagaagatacggaagcccagcaagaatccatatagaaaccgctagggaagtaggaaagtcatttaaagatagaaaggaaatagagaaaagacaagaagagaacaggaaagatagagagaaagcagcggccaaattcagagaatactttccaaatttcgttggagagccaaaatcgaaggacatactcaaattacgtttatacgaacaacaacatggaaaatgtttatacagtggcaaagaaatcaatctaggaaggctaaatgaaaaaggatatgttgaaattgaccatgcattgccattttctagaacttgggatgacagttttaataacaaagtattagtattagggagcgaaaatcaaaataaagggaatcaaacaccatacgaatactttaatggaaaagataattcaagagaatggcaagagttcaaagccagagtagaaacaagtcgctttcctagaagcaagaaacaaagaatattgcttcaaaaatttgacgaagatggcttcaaagaaagaaatctaaacgatacaagatacgttaatagatttctttgtcaattcgtagcagatagaatgaggttaacaggtaaaggtaagaaacgagtgtttgcgtcaaacggccaaataacaaatctacttagaggcttttggggattaagaaaagttagagcagaaaatgaccgacaccatgctctggatgcagtagtagtcgcatgttccactgtagcaatgcaacaaaagattacgaggtttgtcagatacaaagaaatgaatgcatttgatggaaaaaccatagataaagaaactggagaagttttacatcagaaaacacatttcccacaaccctgggagttctttgcgcaagaagtaatgatacgagtatttggaaaacccgacggaaaacctgagttcgaagaagcagacacacctgaaaaactacgaaccctactagcggaaaaattgagtagtagacccgaagcagtacatgaatatgtcacaccactctttgtaagtagagcgcccaatagaaaaatgtcaggccaaggtcacatggaaacagtgaaatcagcaaaacgcttagacgaaggagtctctgtactacgagtacctcttacacaattaaaattaaaagacctagagaaaatggtaaatagagaacgagaaccgaaattatacgaagcattaaaagcaagactagaagctcataaagatgacccggcgaaagcattcgcagaaccgttttataaatacgacaaagcaggaaatcgcactcaacaagtaaaagctgtgagagtcgaacaggtacagaaaacaggagtttgggtaaggaatcataatgggatagctgacaatgcaacaatggtaagggtagacgtgtttgaaaaaggtgataaatattatttagtaccaatatattcatggcaagtcgcaaaaggaattttaccagatagagctgtagtacaaggtaaagatgaagaagactggcaactcatagacgattcgtttaattttaaatttagtctacacccaaatgatttggtagaagtcattaccaagaaagcaagaatgttcgggtattttgcgtcctgtcatagaggaacaggaaatataaatatacgtatacatgacctggaccacaaaataggtaaaaatggaatattagaaggtataggagtcaaaactgcattgagctttcaaaaataccaaatcgatgaactaggaaaagaaataagaccatgccgcttaaagaaaaggcccccggtaagatga

SEQ ID NO: 5034 - RNA, 3249 nt, synthetic construct
  misc_feature 1..3249: note = Cas9 variant
  source 1..3249: mol_type = other RNA
atggctgcatttaaacccaatccaataaattacatacttggcctagacataggaattgcatctgtaggatgggccatggtcgaaattgacgaggaagaaaatccaattagacttatagacttaggagttagagtgttcgaaagagcagaagtaccaaaaacaggtgattcactagcgatggcaagaagactagctcgaagtgttagaagactaacgcgtcgtagagcacaccgattattgagaacaagaaggttacttaaaagagaaggcgtactacaagcagcgaactttgacgaaaacggactaattaaaagtcttccaaacacactatggcaactacgagcagcagctttagatagaaaacttacaccactagaatggtcagcagtattactacatcttattaaacacagaggttacctaagtcaaagaaagaatgaaggcgaaacggcagataaagaactaggagcacttctaaaaggagtagcaggaaatgcacatgcacttcaaacaggcgattttagaacacccgcggaattagcattaaataaatttgaaaaagaaagtggacatatcagaaatcaaagaggagactatagccatacgtttagtagaaaagatctacaagcagaactcaacttattgttcgaaaaacaaaaagagttcggaaatcctcacataagcgacggattaaaagaaggtatagaaactttattaatgacccaacgacctgcactatcgggagatgcggtacagaaaatgttaggacattgtacatttgagccaacagagcctaaagcagctaaaaacacatacacaaccgaaagatttatctggctaacaaaattaaacaatctccgaatactcgaacaaggttctgaaagaccgttaacagatacagaaagagctactcttatggatgagccttatagaaaatctaaactgacttatgctcaagctagaaaattgctcgagctagatgatattgcattcttcaaaggattaagatatggaaaagataatgccgaagctagtacactgatggaaatgaaagcatatcatgcaatatcacgagcattggaaaaagaaggattaaaagataagaaaagcccattaaatctaagtccagaattacaagatgaaatagggacggcattcagtttatttaaaaccgatgaagacataacaggccgattgaaagatagaatacaacctgagatattagaggctttactcaaacatattaactttgataaatttgtgcaaatatcattaaaagcactaagacgtatagtacctttaatggaacaagggaaaagatatgacgaggcttgcgcggaaatatatggagatcattatggaaagaaaaacacagaagagaaaatagatctacccccaattccagcagatgaaatacataatccagtcgtactaagagcactttcacaagcccgaaaagtaatcaatggagtagttcgcaggtatggaagtccagctagaatacacatagaaactgcgagagaggtaggtaaatcttttaaagatcgcaaagaaatagagaaaagacaagaagaaaacagaaaagacagagaaaaagcagcagccaaattccgagaatactttccaaacttcgtaggagaacctaaatcaaaagatatactcaaattaagactttacgaacaacaacatggaaaatgtctatacagcggaaaagaaatcaacctaggccgactaaatgaaaaaggatacgtggagattgaccacgctctcccatttagcagaacatgggatgactcatttaataacaaggttttagtactaggaagtgaaaatcaaaacaagggaaaccaaacaccatacgagtattttaacggaaaagacaactcaagagaatggcaagaatttaaagccagagtcgaaacaagcagatttccaagaagcaagaaacaacgaatattgttacaaaaatttgatgaagatggttttaaagaaagaaacttgaatgataccagatatgtaaatcgatttttatgccaatttgtagctgacagaatgcgactaacaggcaaaggaaagaaaagagtttttgcaagtaatggacaaatcactaatctacttaggggattttggggtctacgaaaagttagagctgaaaacgaccgccatcacgcattagacgcagtagtcgtggcctgcagtacagtggccatgcaacagaaaataactaggtttgtacgctataaagaaatgaacgcctttgacggaaaaacgatagacaaagaaacgggagaagtactccatcagaaaacccattttccacaaccttgggaatttttcgcacaagaagtaatgatcagagtatttgggaaacccgatgggaaacccgaatttgaagaagcagacacaccagaaaagctccgtacactccttaccgaaaaattatcatcaagacctgaagctgtacatgaatatgtaacacctctcttcgtatcgagagcacccaatagaaaaatgtcaggacaaggccatatggaaaccgttaagagtgcaaaaagattagatgaaggaatatcagtgttaagggtacccctaactcaactaaaactgaaagatttagagaaaatggttaacagagaacgagaacctaaactatatgaagctctaaaagcccgactagaagcacataaagacgatcctgcaaaagcatttgccgaaccattttataaatacgataaagcaggcaacagaacccaacaagtgaaggccatgcgagtggaacaagtacaaaagacaggagtatgggtcagaaaccacaatggcattgcagataacgcaacaatggtgagagtagatgtcttcgaaaaaggcgacaaatactatttagtccccatatacagttggcaagtagccaaaggaattttgcctgatcgagcagtagtgcagggaaaggatgaagaagactggcaactaatcgatgatagttttaactttaaattttcattacatccaaacgacctagtcgaagtaataactaagaaagctaggatgtttggatatttcgcctcatgtcacagaggaaccggaaatataaacattagaatacacgaccttgatcataaaattggtaaaaacgggatactagaaggaataggtgtaaaaaccgcactatccttccaaaagtatcaaattgatgaactaggaaaagagataagaccctgcagactaaagaaaagaccaccagtaagatga

SEQ ID NO: 5035 - RNA, 3249 nt, synthetic construct
  misc_feature 1..3249: note = Cas9 variant
  source 1..3249: mol_type = other RNA
atggcagcatttaaacctaaccctattaattacattctcggcctcgatattggtattgcatcagtcggatgggctatggtagaaatcgacgaagatgaaaatccaatatgtttaatagatctaggagtaagagtttttgaaagagcagaagtaccaaaaaccggagatagcctagcgatggcaagaagactagcaagatcagtaagacgtttaacaagaaggagggctcataggttactcagagctagacgattgttaaaaagagaaggcgtattacaagcagcagactttgatgaaaatggattaattaaaagtctccccaatacgccctggcaattgagagctgcagcattagatcgaaaactgaccccactcgaatggtcagccgtactattacatctaattaaacatagaggatatctcagccaacggaaaaatgaaggggaaacagcagataaagaattaggagcgttattgaaaggagttgcagataatgcacacgcactacaaacaggagactttagaacaccagcagaattagcacttaataaattcgaaaaggagtcaggacatataagaaaccaaagaggcgactattcacataccttctccagaaaagatcttcaagctgaattgaacctactattcgaaaagcaaaaagagttcggcaatcctcacatttcagatggccttaaagaaggaatagaaacactattaatgactcaaagaccagcattaagtggagacgctgtacagaaaatgttaggacattgtacatttgaaccggcagaaccaaaggctgctaaaaacacctatacggcagaaagattcatatggctcacaaaactaaacaatttgcgaattttagaacaaggatcagagcgcccactaactgacacagaacgaactacattaatagatgaaccttaccgtaaaagtaagttaacatatgcacaagcacgaaaattgttagaattagacaataccgcatttttcaaaggactgaggtatggtaaagataacgcagaagcctcaaccttaatggaaatgaaagcataccatgcgataagccgagcattagaaaaagaaggactaaaagataagaaaagtccattaaatttatctccagaactccaagatgagatagggaccgcattcagtctgttcaaaactgacgaagatataacaggcagactaaaagacagagtccaaccagaaatcctcgaagcattattaaaacatataagttttgataaattcgtccaaatatcattaaaagcgctaaggcgtatagtaccgctcatggaacaaggaaaacggtatgacgaggcttgtgcagaaatatacggagatcactatggaaagaaaaatactgaagagaaaattgatttaccacccattcccgcggacgaaataagaaacccagtcgttttacgagccttaagtcaagccagaaaagtaattaatggagtagtccgcagatacggatcgccggctagaatacatattgaaacagccagagaagtgggaaaatcttttaaagacaggaaagaaatcgaaaaacgacaagaagaaaatagaaaagatagagaaaaagcagccacaaaattcagagaatattttccaaactttgtcggtgaacccaaatctaaagacatacttaaattaagattatatgaacaacaacatggaaaatgcttatactcaggaaaagaaattaacctaggtaggctgaacgaaaaaggttacgtagaaatagatcatgcactaccgttctcacgcacatgggatgatagtttcaacaataaagtcttagtcctcggatcagaaaatcaaaataaaggaaatcaaacaccatatgaatacttcaatggtaaagacaatagcagagaatggcaagagttcaaagccagagttgaaacatcccgatttccccgatctaagaaacaaagaatcttattacaaaaattcgacgaagaaggatttaaagaacgcaacctaaacgacacaagatatgtaaatagatttctgtgtcaattcgtagcagatcatatgcttctaaccggaaaaggtaaaagaagagtttttgcttcaaacggccaaataacgaatttactaagaggattttgggggctaagaaaagtacgagctgagaacgacagacatcacgcactagatgcagttgtcgtagcttgtagtacagtcgcaatgcaacagaaaatcacacgattcgtacgatataaagaaatgaatgctttcgatggtaaaactatagacaaagaaaccggtgaagtattacatcagaaaacacacttcccacaaccatgggaatttttcgcacaagaagtgatgataagagtttttggtaaaccagacggaaaaccggagttcgaagaagcagatacacctgaaaaactcagaacactattagcagaaaaactaagcagcagacctgaagctgttcacgaatacgtcacaccactattcgtaagccgagctccaaatagaaaaatgtcaggtcaagggcatatggaaaccgttaaatcagccaagagattagatgaaggcgtcagtgttctaagagttcccctaacacaattaaaattaaaagacttagagaaaatggtaaatcgcgaacgagaaccaaaattatatgaagcactgaaagcacgattagaagcacataaagacgatcctgctaaagcatttgcagaacctttctataaatatgataaagcagggaataggactcaacaagtgaaagccgtaagagttgaacaagttcagaaaactggagtttgggtaaggaatcataatggaattgctgataacgcaactatggtacgtgtagacgtattcgaaaaaggtgataaatactacctagtcccgatatactcatggcaagtcgccaaaggtattcttccagacagggctgtcgtacaaggaaaagacgaagaagattggcaactgatcgacgatagtttcaactttaaattctcgcttcatccgaatgatctagtagaagttataacaaagaaagctcgtatgttcggatattttgcctcatgtcaccgcggaacaggaaatattaacattcgtattcacgatttagaccataaaattggcaaaaacgggattctagaaggaatcggagttaaaaccgctctctcctttcaaaaataccaaatagacgaattaggcaaagaaataagaccatgtagattaaagaaaaggccaccagtaagatga

SEQ ID NO: 5036 - RNA, 3249 nt, synthetic construct
  misc_feature 1..3249: note = Cas9 variant
  source 1..3249: mol_type = other RNA
atggcagcgttcaaacccaatccaatgaattacatcttaggactagatataggcatagcttctgtaggatgggcaatagtcgaaatagatgaagaagaaaatcccataagactgatagacttaggagtacgagtatttgaaagggctgaagttccaaaaacaggagattcactagcagcagcaaggcgactagctcgatcagttagaagactaacaagaagacgtgcacataggttactaagagcaaggaggttattaaaaagagaaggcgtcttacaagctgcagatttcgatgaaaacggactaataaaatcactaccaaatacgccttggcaattacgtgctgcggcattagatagaaaactaacaccgcttgaatggtcagccgtattactccaccttatcaaacatagagggtacctatctcaaagaaagaatgaaggggagaccgctgataaagagttaggagctttactgaaaggtgtggcagataacacacacgccttacaaacaggagacttcagaacccctgcagaactagcactcaacaaatttgaaaaagagtctggtcatattagaaaccaacgaggagactattcacatacctttaacagaaaagacttacaagcggaacttaacctattatttgaaaaacaaaaagagttcggaaacccacacgtgagcgacggactaaaagaaggtattgaaacgttattaatgacacaacgaccagcactatcaggagatgctgttcagaaaatgctcggacattgcacattcgaaccaacggaacccaaagcagctaaaaatacttacacagctgaacgattcgtttggttaactaaactaaacaatttaagaatattagaacaaggaagtgaaagacccctaacagatactgaaagggctaccttaatggacgaaccataccgaaaaagcaaacttacctacgcacaagcaagaaaactactagatctagacgacacagcattctttaaaggacttaggtacggaaaagataatgcagaagcatcaacactcatggaaatgaaagcatatcatgctataagcagagcattagagaaagaagggttaaaagacaagaaatccccgcttaatcttagtcctgaattacaagacgaaataggaactgcattttccttatttaaaacagacgaagatataacaggtagattaaaagatagagtacaaccagagatattagaggccctattaaaacatatcagctttgataaatttgtgcaaatctcattaaaagcacttcgccgaattgtaccattaatggaacagggtaacagatacgacgaagcatgcactgaaatatatggcgaccattacggaaagaaaaacacagaagagaaaatttacttacctccaataccagctgacgaaatccgtaatcctgtagtactacgagcacttagtcaagcacgaaaagtaataaacggagtagttagaagatacggatctccagctcgaatacacatcgaaacagcacgtgaagtaggtaaatcgttcaaagatcggaaagaaattgagaaaagacaggaagaaaacaggaaagaccgcgagaaaagtgctgctaaattcagagaatactttcctaattttgtcggcgaaccaaaaagcaaagacattttaaaactccgactatacgaacaacaacacggaaaatgtctttatagtggaaaagaaataaacctcggtagactaaatgaaaaaggatacgtagaaatagatcatgctctcccttttagtagaacgtgggacgatagttttaataacaaagtactagcattaggatctgaaaaccaaaataaaggtaatcaaactccttacgaatattttaatggaaaagataattcaagagaatggcaagaatttaaagcaagagtcgaaacttcacgctttccaagatcaaagaaacaaagaatactgctccagaaatttgatgaggacggatttaaagaacggaatctaaatgacactaggtatataaataggtttttatgccaatttgttgcagatcacatgctattgactggcaaaggaaaacgaagagtatttgcgagcaatggacaaataacaaacttattaagaggcttttggggattgagaaaagtacgagctgaaaatgaccgtcaccatgcgttggatgcagttgtagtagcatgttctacgatagcgatgcaacagaaaataacccggtttgtaagatacaaagaaatgaatgccttcgatggtaaaaccatagataaagaaacaggagaggtactccatcaaaaagcacatttcccccaaccatgggagttctttgcgcaagaagtaatgataagggtattcggaaaaccagatggtaaaccggaatttgaagaagcagatacacccgaaaaattacgaactctattagcagaaaaactttcatccagacccgaagcagtacataaatacgtgacaccgttatttatatctagagcaccaaatcgcaaaatgtctgggcaaggacacatggagaccgtaaaatcagcaaagagattagacgaaggaatctctgtactaagagtcccattaactcaattaaaattaaaagacttagagaaaatggtcaacagggaaagagaaccaaaattatacgaagctctaaaagctcgactagaagcacacaaagatgatcccgctaaagcattcgcggaaccattctacaagtacgataaggccggcaacaggactcaacaagtaaaagctgtaagagtagaacaagtgcagaaaacaggagtatgggttcataatcataatggaattgctgacaatgcaacgatagtaagagtagacgtttttgaaaaaggtggtaaatattacctagttcctatttattcatggcaagtagctaaaggtatccttccggacagagctgttgtgcaaggaaaagatgaagaagattggacagtaatggatgacagctttgaatttaaatttgtactatacgcaaatgatttaattaaattaacggctaaaaagaacgaatttttaggttatttcgtctcattaaatagagcaacgggagcaatagatatcagaacccatgatacagactctaccaaaggcaaaaacggaatatttcaatcagtaggagttaaaaccgcactaagttttcaaaaatatcaaatagacgaactaggaaaagaaataagaccatgccgacttaagaaaagacctcctgtcaggtga

SEQ ID NO: 5037 - RNA, 3249 nt, synthetic construct
  misc_feature 1..3249: note = Cas9 variant
  source 1..3249: mol_type = other RNA
atggcagcatttaaacccaattcaattaattacatactcggtttggatatcggtattgccagtgtaggttgggcaatggtcgaaatagacaaagaagaaaacccaatccgacttatagatctaggagttagagtcttcgaaagggcagaagtacctaaaacaggtgattccttagcagccgcacgccgactcgcaaggtcagtgagacgactaacaagaaggagagctcacaggctactcagaacaagaaggttactgaaaagggaaggagttctacaagcagcgaactttgataaaaatggattaataaaatctttaccaaacacattatggcaattacgagcggctgcactagatagaaaactaacgccacttgaatggtcagcagtactactacacttaataaaacataggggatatttgagccaacgcaaaaacgaaggagaaacagcggacaaagaattgggagcattactaaaaggagtcgcaggaaacgcccatgctctacaaaccggtgattttagaacccctgcagaactagcactaaataaattcgaaaaagaatcaggacatatacgtaatcaaagaggagactattcacacacattttcaagaaaagatttacaagctgaacttaatttactctttgagaaacagaaagaatttggtaacccccatataagtggaggcctcaaagaagggatagagacattacttatgacccaaagaccggccttaagtggggacgcagtacagaaaatgctgggtcactgcacatttgaaccaactgaaccaaaagcagctaaaaatacttacacaaccgaacgtttcatttggctaaccaaattaaataacttaaggattttagagcaaggatcagaaagaccattaacagatacagaaagagcaacactcatggacgaaccataccgaaaatcaaaattaacatacgcacaagcaagaaaactactctctctagaagatacagcctttttcaaaggattaaggtatggcaaagataacgccgaagcgtcaactttaatggaaatgaaggcgtaccacacaattagcagagcactagaaaaagaagggttaaaagataagaaatctcctctaaatctatctcccgaactacaagacgaaataggtactgcgtttagcctatttaaaacagacgaagatataacaggaaggttaaaagacaggatacaaccagaaatattagaggcattattaaaacacataagtttcgataaattcgtgcaaatatcattaaaagctctaagaagaatagttcctcttatggaacaaggtaaaagatacgatgaagcatgcgccgaaatttatggtgaccattacgggaagaaaaatacagaagagaaaatatatttacccccaataccagcggatgaaataagaaatccagtcgtactcagagcgttaagtcaagcaagaaaggttataaatggtgtggtgagacgatatggaagtcctgcaagaatacatatcgaaacagcaagggaagtaggaaaatcatttaaagacaggaaagaaatagaaaagagacaagaagaaaataggaaagatcgggaaaaagctgccgcaaaattccgtgaatacttcccaaatttcgtgggggaaccaaaatcaaaggatatactaaaattaagactttatgaacaacaacatggaaaatgcctatattcaggcaaagaaattaatctcgtaagactaaacgaaaaaggctatgttgaaatagatcacgccttaccgttttccaggacttgggacgatagttttaacaataaagttttggtccttggctcagaaaaccaaaataaaggcaatcaaacaccatatgaatactttaatggaaaagacaactcgagggaatggcaagaatttaaggcaagagtagaaacatcacgttttcctagatccaaaaagcaaagaatattactccaaaaattcgacgaagacggtttcaaagaaagaaaccttaacgacacgcgatatgttaatagatttctttgccaatttgtagcagaccacattttactaacaggcaaaggaaaaagaagagtgtttgcgtcaaatggacaaataactaacttgctacgcggtttttggggactacgaaaagtacgcgctgaaaacgatagacaccacgccctggatgcagttgtagtagcatgttcaacagtcgccatgcaacaaaagataaccagattcgttcgatataaagaaatgaatgcatttgatggaaaaacgatagataaagaaaccggagaagtccttcatcagaaaactcactttccacaaccatgggagttcttcgcacaagaagtaatgattcgtgtttttggaaaaccagatggaaaaccagaatttgaagaagccgatactttagaaaaactaagaacattgttagcagaaaaattgtcaagtcgtcctgaagcagtacatgaatatgtcacaccgctctttgtatctcgagcaccaaatagaaaaatgtccggccaagggcacatggaaacagtaaaatcggcaaaaagactagacgaaggagtgtcagtattaagagtcccgttgacacaattaaaattgaaagatctagagaaaatggtaaatcgcgaaagagaaccaaaactatatgaagccttaaaagcaagactagaagcacacaaagatgaccctgcaaaagcattcgctgaaccattctacaaatatgacaaggcgggaaacagaacacaacaagtcaaagcagtacgagtagaacaagtgcagaaaaccggagtatgggtccgaaatcataacggaatagcagacaatgcaacgatggttagagttgacgtttttgaaaaaggagataaatattatttggtaccaatttattcatggcaagtagcaaaaggaatattaccagatagagcagtagtacaaggaaaagacgaagaagattggcaactaattgacgactcatttaacttcaaatttagtcttcatccgaatgacttagtagaagtaataacaaagaaagctagaatgttcggatattttgcttcatgtcacagaggtacaggaaatataaacataagaatacacgatctggatcacaaaatagggaaaaacggaatactagaaggaataggagtcaaaacggccctctctttccaaaaatatcagatagatgaattaggaaaagaaataagaccatgtagacttaagaaaagacccccagttaggtga

SEQ ID NO: 5038 - RNA, 3249 nt, synthetic construct
  misc_feature 1..3249: note = Cas9 variant
  source 1..3249: mol_type = other RNA
atggcagcatttaaacccaatcccataaactacattctaggactagacattggaatagcctcagtaggatgggcaatggtcgagatagatgaagaagaaaaccccataagactaatcgatttaggagtacgagtctttgaaagagcggaagttcctaaaacaggagactcactagctatggttagaagactcgcaaggagtgtaagaaggctgactaggcggagagcacatagactcctcagagctagacgattattaaaacgcgaaggagtcttacaagcagccgattttgatgaaaacggactaataaaatctttaccaaatacaccctggcaactacgggcggcggcactagacagaaaactcacaccattagaatggagtgcagttctattgcatctaattaagcatcggggatacttatcacaacgtaaaaacgaaggagaaacagcagataaagaattaggtgctctattaaaaggagtagcagacaacgcacatgcacttcaaacaggcgatttcagaactccggcagaactagcattgaataaattcgaaaaagaaagcggccacatcaggaaccaaagaggagattatagccacactttcagccgtaaagacctccaagcagaactcatattacttttcgaaaaacaaaaagagtttggtaaccctcatatatccgggggactaaaagaaggaattgaaactctattaatgacacaaagaccagctctatccggagatgcagtgcagaaaatgttaggacattgcacattcgaacctgcagaacccaaggcagctaaaaatacatataccgcagaaaggtttatttggctaacaaaattaaataatttaagaatcttagaacaaggaagtgaaagacctctgactgatacagaacgtgcaacattgatggacgaaccatatcgcaaatcaaaactgacatatgcacaagcacgcaaattattaggattagaagacacggcatttttcaaaggacttagatacggaaaagataatgccgaagcaagcacattaatggaaatgaaagcatatcatgcaataagccgcgcattagaaaaagagggactaaaggacaagaaaagtcccttgaatcttagtccggaattgcaagacgaaatcggaacagccttttcactatttaaaacagatgaagacataactggaagattaaaagatcgaatacaacctgaaatactggaagcactattaaaacatatcagtttcgataagttcgtacaaataagtttaaaagcactaagaaggattgtcccactcatggaacaaggaaaaagatatgacgaagcatgtgcagaaatctacggagatcattatggcaagaaaaacactgaagagaaaatatacttaccacctattccggcagatgaaatacgtaaccctgtggtattacgagcactatcacaagctaggaaagtaataaatggagtagtccgaagatatggatctccagcacgcattcacatagaaaccgcaagagaagtaggtaaatcatttaaagacagaaaagaaatagaaaaacgtcaagaagaaaacagaaaagatagagaaaaggcagcggcaaaatttagagaatattttcccaattttgtaggagagcctaagagtaaagacatattaaaattacgcctatacgaacaacaacatggcaaatgtctatatagcggaaaagaaataaatttaggacgtctaaatgaaaaaggctatgtagaaatcgatcacgcattaccattttcacgaacttgggacgactcatttaacaacaaagtattagtattaggaagcgaaaaccaaaataaaggaaaccaaacgccctatgaatattttaacggaaaagataacagtagagagtggcaagagttcaaagcccgagtagaaacatcacgatttccgagaagcaaaaagcagcgaatacttttacaaaaatttgacgaagatggattcaaagaaagaaatttaaatgatacaagatatgttaacagatttctttgtcaatttgtagcagatcgaatgcgtctaacaggaaaaggtaagaaaagagtttttgcttcaaatggccagataactaacttacttagaggattttggggtcttcgtaaagtaagggctgaaaatgaccggcatcatgcactagacgcagttgtcgttgcatgctcaacagtagcaatgcaacagaaaatcactcgtttcgtgcgatacaaagaaatgaacgcatttgatggaaaaacaatagataaagaaacaggagaagttttacaccagaaaacacactttccacaaccttgggagttctttgcccaagaagtaatgattagagtatttggaaaaccagacggaaaacccgaatttgaagaagcggataccccagaaaaactcagaacacttttagcagaaaaactctcatcaagaccagaagcagtacacgaatacgtaactccattatttgttagccgagcaccaaatagaaaaatgtcaggtcaaggacacatggaaacagtcaaatctgctaaacgacttgatgaaggagtatctgtactacgcgttccactcacacaactaaaacttaaagacctagagaaaatggtcaatcgcgaaagagaacctaaactctatgaagcactaaaagcaagactagaagcacataaagatgacccagcaaaagcgtttgcggaaccattctacaaatatgataaagcagggaacaggacacaacaagtaaaggctgtaagggtagaacaagttcagaaaactggagtatgggtccgcaatcataacggaattgcagacaacgctacaatggtaagagttgatgtatttgaaaaaggcgataaatactacttagtaccaatttattcatggcaagtagccaaaggaatattacccgacagagccgtggttcaaggaaaggacgaggaagactggcaactcatagatgactctttcaacttcaaatttagtctccatccaaacgatttagttgaagtaataactaagaaagcaagaatgttcgggtacttcgcatcttgtcacagaggaacaggaaacatcaacatccgaatacatgatttagaccataaaataggtaaaaacggaatattagaaggaataggagtcaaaacggcactctcgtttcaaaaatatcaaatagatgaactcggaaaagaaatacggccctgcagactaaagaaaaggccacccgtaagatga

SEQ ID NO: 5039 - RNA, 3249 nt, synthetic construct
  misc_feature 1..3249: note = Cas9 variant
  source 1..3249: mol_type = other RNA
atgagagttctaggattagatgcgggaatagcgtcattaggctgggcactaatagaaatagaagaaagtaatagaggggaactaagccagggaactataatcggcgcaggaacgtggatgtttgatgcgccagaagagaaaacacaggcgggtgcaaaactaaaatcagaacaacgaagaacatttagaggacaaaggagggtagtcagacgcagaagacaaagaatgaatgaagtaagacgaattttacacagtcatggactcttgccatcatcagacagggacgctttgaaacaacccggattagacccgtggagaataagagcagaagcacttgatcgacttttaggaccagtagaactagctgttgcactaggacatatagcacgacatcggggattcaaatcaaatagtaaaggagctaagactaatgacccagcagacgatacatcgaaaatgaaaagggctgtgaatgaaacacgtgaaaaattagcgagatttggatcagcagccaaaatgctagtggaggacgaaagttttgttttaagacagacaccaacgaaaaatggggcaagtgaaatagtcagaaggtttagaaatagagaaggggattacagtagatcacttctaagagatgatttggcggcagagatgagagccctttttacagcacaagctagatttcaatcagctatagctactgctgatttacaaaccgcattcacaaaagcagctttctttcaaaggccactacaagattcagagaaattagttggtccatgcccttttgaagttgacgagaaaagagctccaaaaagaggatactcgtttgaactttttaggtttttaagccgacttaaccatgtaacactcagagacgggaagcaagaaagaactttgacccgagatgaattggctttagcagcagcagattttggagcagcagcaaaagtatcatttacagcactaagaaagaaactaaaattacctgaaacaactgtttttgttggagtaaaagccgacgaagaaagtaaattggatgtagtggccagatctggtaaggcagcagagggaactgcaagattacgttcagtaatagtagatgccttaggagaattggcttggggagcattattatgctcaccagaaaaactagataaaattgcagaggtaatatcattccgaagcgacataggacgaatatcagaaggtttagcacaagcaggatgtaacgcgcctttagttgacgcacttacagcagcggcttctgatggtcggtttgacccgttcacaggcgcaggacatatttcgagcaaggcagcaagaaacatactgtctgggctaaggcaggggatgacatatgataaagcgtgttgcgcagcagattatgaccacacagcttcaagagagagaggtgcattcgatgtaggtggccacggaagagaggcattaaaaagaattttacaggaagagaggataagtagagaattagtaggctccccaacagccagaaaggcgctaattgaaagtataaagcaagtaaaagctattgtggaaagatatggggtgccagatagaatacatgtagaattagctcgagatgtaggaaaatcaattgaagaacgagaagaaataactagaggaatagaaaaacgaaaccgacaaaaagataaacttagaggattatttgagaaagaagttggaaggccaccacaagatggggcaagaggaaaggaagaattattgaggtttgaattatggagtgaacaaatgggaagatgtctctatacagatgattacatatcaccatcacaattggttgcaacagacgatgcagtacaagtagaccatatattgccatggtcacgatttgctgatgattcatatgcgaataaaacattatgtatggccaaagcaaaccaggataagaaaggaagaaccccatatgaatggttcaaagcggagaaaaccgacacagaatgggacgcgttcatcgtaagagtggaagcacttgcagatatgaaaggatttaagaaaagaaattataaactcagaaacgcagaagaagcagctgcaaaattcagaaacagaaatttaaacgatactcgatgggcgtgcagactcttggcagaagcattaaaacaattgtatccaaaaggagaaaaagataaagacggaaaagaaagacgaagggtgttttcaagaccaggagccttaactgatagattacgtagagcctggggattacaatggatgaagaaatcaacaaaaggagaccgcattccggatgacagacatcatgctcttgacgcgatcgtaatagctgcaacaacagaatcactgctgcagagagcaacaagggaagtgcaagagatagaagataaagggctacattacgatctagtcaaaaatgtaactccaccttggccaggattcagggaacaagcggttgaggctgtagaaaaagtatttgtggcgagagctgaaaggagaagggcgaggggaaaagctcacgatgcaacgataaggcatatagcagtaagagagggagaacaacgggtttacgagagaagaaaagttgctgaattaaaattagctgacttagatagggtaaaagacgccgaaagaaacgctagattaatagaaaaactaaggaactggattgaagctggaagtccaaaagatgatcccccattaagtccaaaaggagatccaatattcaaagtaaggctagtaacaaaatcaaaagtgaacatagcattagacacaggaaacccaaaacgacctggaacagtcgatcgaggcgaaatggcacgagtggatgttttccgcaaagctagtaagaaaggaaaatatgaatactatctagtacctatatatccacacgatatagcaacaatgaaaacacctccaattagagccgtacaagcatataaaccagaggatgagtggccagagatggattcatcatatgagttctgctggtctttagtaccaatgacgtatctacaagttataagtagcaaaggagaaatatttgaagggtattacagaggaatgaataggtctgttggtgcgatacagctaagcgcccattcaaatagttcagatgttgtgcagggaataggagccagaacgttaactgagttcaagaaattcaacgtagacagattcgggagaaaacacgaagtagaacgagaattaagaacatggagaggagaaacctggcgagggaaagcgtatatttga

SEQ ID NO: 5040 - RNA, 3255 nt, synthetic construct
  misc_feature 1..3255: note = Cas9 variant
  source 1..3255: mol_type = other RNA
atgaaaaacaccttatatggaataggcttagacataggagtagcttctgtaggatgggctgtagtaggactaaatggcactggcgaaccagtaggtctgcatcgtctcggagtacgaatattcgataaagccgaacagcctaaaactggtgaatcattagctgccccgagaagaatggcaaggggcatgagacgaagactcaggagaaaagcgctaaggagagccgatgtctatgctctactagaaagatcaggcctatcgacaagagaagcattagcacacatgtttgaagcgggcggcctagaagatatatatgcactaagaacccgagcattagatgaaccagtgggtaaagcagagttcagccgaattttactacacttggctcaaagaaggggatttaaatcaaaccgaagaacagctagtgatggcgaagatggcagattgttggccgctgtgaacgaaaatcgcagaagaatggcacagggagggtggagaaccgtcggagaaatgctatatagacatgaagcatttgcactacataaaaggaataaagcagacgaatacctatcaacggtaggaagagatatggtcgctgaagaagcaagtctactatttcaaagacaaagggagttggggtgtgcctgggcaacaccagaattacaagcagaatatctgtcaatactacttagacaacgatcatttgacgaaggaccagggggaaactcaccatatggaggtaatcaagtcgagaaaatggtaggaagatgtacgttcgaacccgatgaaccaagagctgcaaaagcggcatatagcttcgaatacttcagcctcttacagaaaatcaatcacatcagattggtagaaaatggtgaaacaaggccactaactcaacaacaacgtcagcaattactaagtctcgcacacaaaacacctgatgtcagcttagccagaataaggaaggaacttgcactcccggaaacggtgcaattcaacggagtgagatgcagagcaaacgaaactctagaagaaagtgaaaagaaagaaaaatttgcgtgtctgcccgcatatcataaaatgagaaaagccttagacggagtagttaaaggaagaatcagctctctaagtatcagtcaaagagatgcagcagccacagctcttagtctatacaaaaatgaagatacattacgagcaaaattaacagaagcaggctttcaagctccagaaatcgatgctctagctggattaaccgggttctctaaatttggacatctaagtctgaaagcatgtagaaaattaatacctcatcttgaacaaggactaacctacgatcaagcctgtagtgcagccgggtatgactttaaagggcatggcgctggtgaaagagcattcacactacctgcagcagcaccagaaatggaacaaataacttctccagtagttcgaagggcagtagcacaaacaataaaagtcgttaacgggatcataagagaaatggacgcatcaccggcatgggttagaatagaactagcgcgcgaattatccaaaacatttggggaaagacaagaaatggatcgttcgatgagagaaaacgccgcacagaacgaaagactaatgcaagaacttcgtgacacatttcatctgctatcacccactgggcaagaccttgtaaaatatagactttggaaagaacaagatggagtttgcgcttactcactaagacgtttggacgtagaaagactatttgaaccgggctacgtagacgttgatcacatagtaccatattcacttagcttcgatgatagacgctcaaataaagttctcgtgctctcatcagaaaatcgtcaaaaaggtaatagattaccattacagtatctgcaaggaaaaagaagagaggactttattgtatggacgaacagtagcgttagagactaccgaaaaagacaaaatctcttaagagaaaaactgtcaggcgacgaagcagaggggtttcggcaaaggaatttgcaagatactcaacatatggcaagatttttatataattacataagtgatcatctggcattcgctcaatcagaagcccttggaaagaaacgggtctttgcagtcagcggagctgtgacaagtcatcttcgcaaacggtggggacttagcaaagtaagagcagatggagatttacatcatgcactggatgcggcagtcatagcttgtaccacagatggcatgatacgaagaataagcggatactacggacacattgagggagaatacctacaagatgcagacggagcaggaagccaacacgcaagaactaaagaacgttttcctgcaccttggccccgatttcgagatgaactaatagtaagactaagcgagcaaccaggagaacatctgctagatataaatccggagttctattgtgaatatgggacagaacacataagaccagtattcgtatcacgaatgcctagaagaaaagtcactggcccaggacacaaagaaacgataaagggagccgccgctgcagatgaaggcctacttacagtaagaaaagctctaacagaactaaaacttgataaggatggagaaattaaagactattacatgccaagcagtgatacgttattatacgaagcactcaaagctcaattacgacgctttggaggagatagcaagaaagcatttgcagaaccattctacaaaccaaaagccgatggtaccccaggacctctagtaagaaaagtaaaaactacagaaaaagccacactaaccgttccagtgcatggaggagctgcatcaaacgacactatggtaagagtagatgtatttttggtgccaggagacggatactattgggtgccggtatatacagcggacacgcttaaaccagaactaccaaacagggcagtagtacaaggaaaaccttattctgaatggaaagaaatgcgagaagaagactttatatttagcctatacccaaacgatctagtatatgttgaacacaaatcagggctaaaattcaccttacagaacgcagatagtacattagagaaaacccgaacacaaacctcggcatttgtatattttgtaggtggttcaataagcacagcttcaataacaataagaacacatgacaatgcttacggcatcccaagcctaggagttaaaactttaaaaaccttccataaatatcaagtagatgtattaggaaatgtattcccagtacataaagaaacaagacaaaaatttaggtga

SEQ ID NO: 5041 - RNA, 3255 nt, synthetic construct
  misc_feature 1..3255: note = Cas9 variant
  source 1..3255: mol_type = other RNA
atgaaaaacactctatatggaatcggtctcgatataggtgtagcaagtgttggttgggcagtggttggacttaatggaacaggtgagccagttggattacacaggttaggtgtaagaatatttgataaagcagaacaaccaaagacaggagaaagtttagcagcaccaagaagaatggcaagaggcatgagacgaaggttgagaagaaaagcgttaagacgagcggatgtttacgccttactagaacgatcaggactaagcacgagagaagcattagcacaaatgtttgaggcgggtggactcgaagacatttatgctctaagaacaagagcattagatgagccagtaggaaaggccgaattttcaagaatacttttgcatctagcacaaagaagagggtttaagagcaatagaagaaccgcttccgatggagaagatggaaggttactagcagcagtgaacgaaaataggagacgaatggcacaagggggatggcgcacagtaggagaaatgctatatcgacacgaagcatttgcattacacaaaagaaacaaagctgacgattatctatcaactgtaggaagagatatggtagctgaagaggcttcattattatttcaaagacaaagagaactggggtgtgcatgggcaacaccagaactacaggcggaatacctaagtattctactaaggcagaggtcatttgatgaaggtcccggtggagattcaccatatggtggaaatcaagtagagaaaatggttggtagatgcactttcgaacctgacgaacctagagcagcaaaagcagcatatagttttgaatatttctctttattacagaagataaaccatataagacttgccgaaaatggtgaaactagacctctcacacaacctcaaagacagcaattattatccttagcacataaaactcctgatatgtcactagcaagaattagaaaagaactagctttgccggagacagtacaattcaacggagtaagatgccgagctaatgaaacactcgaggaatctgagaagaaagaaaaattcgcatgtttacccgcatatcataaaatgaggaaagccttaggtggtgtagtaaaaggcaggatatcttccctctccatcagtcagagggatgcagctgccacggctttaagtttgtataaaaatgaagacacactgagggctaagttaacagaagcaggatttcaagcacccgaaattgatgcactagcagggttaacaggtttttcaaaatttggccatttatctttgaaagcatgccgaaaactgataccacatctagaacaaggactaacatatgatcaggcttgctcggcagcaggatacgactttaaaggtcacggagcgggtgaaagagcatttacattaccagcagcggctcccgaaatggaacaaattacctctccggtagtgagacgagccgtagcacaaacaataaaagtagttaatggtataataagagaaatggatgctagtccagcttgggtaagaatagaattagctagagaattatctaaaacttttggagaaagacaagaaatggaccgctctatgagagaaaatgcagccaaaaatgaaagactgatgcaagaacttagagatacattccatcttctttctccaacaggccaagacctagtaaaatacaggctttggaaagaacaagacggcgtatgcgcatacagccttcaacgattagatgttgaacagctttttgaaccaggatacgtagacgtagaccatatagtaccctatagtttgagctttgatgatagaagatcaaataaagtattagtattaagttcagagaatcgacaaaaaggaaatagattaccattgcagtatctacaaggaaaaagacgagaagatttcatagtctggacaaactctagtgtacatgactacaggaaaagacaaaacctattaagagagaaattatcagatgatgaagcggaaggatttagacaaagaaatctacaagatacccaacatatggccagatttctgtataattatataagcgaccatctagcttttgcacaatccgaggccctaggaaagaaacgagtatttgcagtatccggagccgtgacaagtcatttacgaaaaagatggggactctcaaaagtacgagctgatggagacttacatcatgcattggatgcagctgtagttgcgtgtacaactgatggtatgattagacgtataagcgggtattatggacacatagaaggagaatatttccaagacgcagacggagctggttcacagcatgcccgtacaaaagaaagattccctgcaccttggccaagatttagagatgaactaatagttagactctcggaacagcccggtgaaccactactcgacataaatccagcattttactgtgaatatggaacagaacatataagaccagtttttgtatcaagaatgccaagaagaaaagtaacgggtccaagccataaagagacagtaaaaggagcagcagcagccgatgaaggactcttaacagtcagaaaggctttgacagaactaaaattagataaagacggagagataaaagactattatatgcctagcagtgatactttactatacgaagccctcaaagctcaattacgtagatttggaggagatgggaagaaagccttcgcagaacccttttacaaacccaaagctgatggaacacctggaccgttagtcaggaaagtcaaaactactgaaaaagcaaccttaacagtaccagtacacggtggagctgcatcaaacgatactatggttagaatagatgtattctttatgccaggcgacggatattattgggttccactatacgtcgcagatacacttaaacctgaactacccaatcgagccgtagtagcacacaaaccatattctgaatggcaggaaatgcgtgaagaagatttcgtatttagtctatatccaaatgatttagtgtacgtagaacataaaagcgaattaaaatttacagtacaaaacgcagacagtacattagagaaaactagaacgcaagcaagtgcattcgtgtattttgtgtccggtggaatttcaggtggcacaataacagtaagaactcatgacaattcctacggaatacctagtctaggcctaaaaacattgaaatcattatgcaaataccaagtagatgtattaggtaatgtcttcccggttcataaagaaactcgtcaaaaattccgatga

SEQ ID NO: 5042 - RNA, 3255 nt, synthetic construct
  misc_feature 1..3255: note = Cas9 variant
  source 1..3255: mol_type = other RNA
atgaaaaacacgctatatggaatagggctcgatataggagtagcatcagtcggctgggcagtcgtaggtctcaatggaacaggcgagcctgttggtttacatcgcctaggagtgagaatattcgataaagcagaacaaccaaagacaggagaatcattagcagcacccagaagaatggccagaggtatgagaagaagattacgtcgaaaggccttacgacgtgcagatgtttacgctttacttgaaaggtcgggactatcaacacgtgaagaattagcgcaaatgtttgaagcaggcggcttagaagacatctacgcactaagaacgcgagcattagacgaacccgttggaaaagcagaatttagcagaatacttttacatttagcacaaagaagaggatttaaatcaaacagaagaacagcaagtgatggagaagacgggaggctactagcagcagtaaatgagaatagaagaagaatggcacaaggaggatggagaacagtaggagaaatgttatacagacatgaagcattcgcattacataaaagaaacaaagctgatgactacctaagtaccgtaggtagagatatggtagctgaagaagcaagtattctattcgagagacaaagagcaatggggtgtagctgggccgctcccgaactacaagctgaatacctatccatattactaaggcaaagaagttttgatgaaggacctggaggcaatagcccctatggaggaaatcaggttgagaaaatggttggaagatgtacattcgaacccgacgaacccagagcagcaaaagcagcgtacagcttcgaatatttttcccttttacaaaaactaaatcatattagactagcagaaaatggcgaaacaagaccactgacccaaccacagagacaacaattattaagtctcgctcataaaaccccggacataagtctagcacgaataagaaaagagttagccctacctgaaactgtacaattcaatggagtacgatgtagagcaaatgagacacttgaagaaagcgagaaaaaggaaaaatttgcatgcctacctgcctaccacaaaatgcgaaaagcattggatggtgttgtaaaaggcagaatttcgagtttatcaataagtcaacgggacgctgccgccacagcactatccttgtacaaaaatgaagatacattaagggcgaaacttaccgaagcaggattccaagctcctgaaattgatgcactagcaggactgaccggtttttcaaaattcggtcatcttagtttaaaggcttgtaggaaactaatcccacatttagaacaaggtctgacatatgaccaagcatgtacagcggcaggctatgattttaaaggacatggcgcaggggaaagagctttcactttaccggcggcagcaccagaaatggaacaaatcacaagcccagtagtgcgacgagcagttgcacaaacaattaaagttgtaaacggaataatacgagaaatggatgcaagtccagcatgggtacgaatagagttagcacgagaactttcaaaaactttcggagaacggcaagaaatggacagatcaatgagagaaaacgcagcgcaaaatgaaaggttaatgcaagagctaagagacacttttcatttactgtcaccaacgggtcaagatcttgtaaaatatagactatggaaagaacaagacggagtatgtgcatattcattaagaagattggatgtagaacgattattcgagccaggatatgtcgacgtagaccatatagtaccatatagtctatctttcgacgatcgaagaagtaataaagttttagtactgtcaagtgaaaataggcaaaaaggaaatagattaccattgcaatacctacaagggaaaagaagagaggactttattgtatggacaaattcatcagtacacgattatcgtaaacgtcaaaatttactaagagaaaaactgtcaggtgacgaggcagaaggatttagacaaagaaatttacaagatacacaacacatggcccgattcctttataactatatcagcgaccacttagcttttgcacaatcagaagcactcgggaagaaacgagtgtttgcagtgtcgggagcagtaaccagtcatctaagaaaaagatggggattatcaaaagtgagagcagatggtgatttgcatcacgcattagatgctgcagtggtggcatgtaccactgatggtatgattagaaggataagtggatattatggacacatagaaggagaatatctacaagacgcagatggcgcaggtagccaacatgcaagaacaaaagagagatttccagcaccatggcctagattcagagatgaattaatagtaaggctatcagaacaacccgcagaaccattactagatataaacccagagttctattgcgaatatggaacagaacacatacggccagttttcgtatcaagaatgccacgaagaaaagtaacaggacctggtcataaagaaacaataaaaggcgctgcggccgcagacgagggattgttaacagtaagaaaagcattgacagaactaaaattagataaagatggagaaattaaagattactatatgccttcatctgatacactactttatgaagctctgaaagctcaacttcgaaggtttgggggagacggtaagaaagcatttgcagaaccattttataaaccaaaagcagatggtaccccaggaccactggtccgaaaagtaaaaacaacagagaaagcaacgcttacagtccccgtacatggaggggcagcatcaaacgacacgatggtcagggtagatgtatttttagtgccgggcgatggttattattgggtaccagtatatacagccgacacacttaaaccagagctcccaaatcgtgcagtagttcaaggtaaaccttatagtgaatggaaagaaatgcgagaagaagattttatatttagtttatatcccaatgacctagtttacgtagaacataaaagcggtttaaaattcaccttgcaaaatgcggactcaacattagagaaaacaagaacacaaacatcagcgtttgcgtattttgtttcaggatccataagcacggcatcaataacaattcgtacacatgataatgcatatggaataccttcattaggagttaaaactctaaaaacctttcataaataccaagttgatgtactaggaaatgtgtttccagtacataaagaaacacgccaaaaattcagatga

SEQ ID NO: 5043 - RNA, 3255 nt, synthetic construct
  misc_feature 1..3255: note = Cas9 variant
  source 1..3255: mol_type = other RNA
atgagactcggactcgacataggaacaaattcaataggctggtggctatatggtacagaaggaggtagaataacagaagttgtagacggtggagtaagaatattctcagatggaagagatccccaaagcaaagcaagtctagcagttgaccggagagcagctagatcgcaaaggcggcgaagggaccgatatttaaggagaaaggcggcactcatgaaaagaatggcacaagtaggtttgatgccagcagatccagcagaagcaaaagtactcgaagttcttaacccatatgaattgagagccagcggattagacggaccactaccactaacacattttggtagagctcttttccatttaaaccaacggagagggtttaaaagcaaccgaaaaaccgatagaggagataatgaatcaggaaaaattaaggatgccacagcacgacttgatcaagcaatgatggcaaagggcgcaagaacatacggtgaatttctacatatgaggagagcagccgctttagatcctaaatcagttcctagtgttagaacacggttgactgtagcaaggagggacgacgctgagaaagaagaagcagggtatgatttctatccggacaggaaacatttatcggaagaatttgataaattatgggccgcgcaagctcgccacgctccagacgttcttacagaagatttacgcgacgaaattgcaacaataatctttcaccaacgaccacttaaaacaccagaagtaggtctatgtctatttacaggacaacacggagtacctgaacgagacaaaagaataccgagtgcacatcctttaaatcaaagacgaatcctcatggaaacagttaacaacttaaaagtagcagcacaaggagaacctagcagaccactaacaagagaagaaagggatcaaattgtacacgcactagacaacaaaaagcacacaaaaagtctttcaggaatgactatgaaactaaaagcattgggaaaggttattaaactaaggcccgaacaaggatttacactcgagactgctaacagagacgcaatagcttgcgacccagtaagagcaagtttaagtcatcccgacagattcggggcgagatggagtacattagaatctgcaggtcagtgggatgtagtacaaagaataagagcggtacaaagtgatgctgaacatgcagatttagtcggttggttaatggatgtgcacggtttagatcgagatcacgcggaagaaaccgcaaatgcacctctaccagaaggttacggtagattaggcctgacagctactactagaatactagccgccctagaagccgatgtgctgaactattcagctgcagtggcagcatgcggatggcatcatagtgatggtagaacgggagaagttttggaatcactaccttactacggggaaatactagaaagacatgtaattccaggaactggagatcccaatgatgatgatgtgaaaagatacggtcgaatcacaaatcctactgtacatatagggttaaatcaactaagaagacttgtaaatcgaataataacagtatacggacgacctgatgaaatagtggtcgaactagctagagatctaaaactcagtgaagatcaaaagaaagatgtccaaagggatatcaagaaaaacacagaagctgcaataagacgcggaaagaaattagaagaaatgggagttccaaacaccggagccaacagaatggtactaaggttatgggaagacttgggagatgacgttatgacaagaaattgcccatatacaggcaaaaggataagcgcaggaatgttatttgacggaagctgtgacgtggatcatattctaccgtactcaagaaccctagatgatagttttgctaataggaccctctgtctaaaagaagccaataggcagaaaactgataaaacaccatgggaggcctggggagaaacagagcaatgggaagcaatcgcagcaaacctcaaaaatctaccagccaataaagcctggaggtttgcaccagacgcaatggaaagattcgagggtgaaaaagatttttcagcaagagcgctagccgacactcaatatttaagtcgaattgccagggcatatctagacgcattatatgatggagatgatggaaaatcccatgtctgggtagtacctggtagactaacagaaatgctcaggaggcattggggtctaaacggagttgctgctttaacagatagcgataaacaaacagtcaaagctaaaaatcgaacagaccacagacatcatgcaattgacgctgcagtagtagccgcaactgatagaggactaattaaaagaatagcagatatggccaaaagagatgagtttaatggagcagaagaagtcgcccggagtataccaccaccttgggaaggatttcgtgacgatgtttcggcacaagtaactagaataatagtaagccacagagcagatcatggaagaattgacccggcagccagaaaatcaggcagagatagtacatctggccaattacataacgatacagcttatgggataggtagagacggcacagtggtatccagaaaaccattagcatccttatcgccaaatgacatagttgtaacaaaacgtggcgctaatatacgggacgttgacctgcaaaagcatttagcaagagttacccacggtttagatggaaaggcatttgaagctgctcttttagcctttgcagcaagcccaatattacctgataacactgataatccatacttcggtttacggcgggtgcgactagaagagacgttgcaagaatctgctagagtagaagtagccgatcaagaaggaaggccctacaaagcatataaaggagatagcaaccattgctatgaaatatggtgcctaccagatggaaaaataaaaccacaggttgttactacctacgaagctcaccaaagcggcgcagaaaagaaaccccacccagcagcaaaaaggcttatgagaatttttaaacgagatatggttatgctagaaagggacggagaaacaataattggttatgtacagaaaatgaaacaaaatggcagcatatttgtggcacctcacacagaagctaatgcagacgcacgagacagggatccaaaagatgactttaaattaatacaattaggcgcgggttctcttgtaaaagcaaaagcaagacgagtaatagtggacgaaatgggacgactaagagacccaggaccacccttatga

SEQ ID NO: 5044 - RNA, 3258 nt, synthetic construct
  misc_feature 1..3258: note = Cas9 variant
  source 1..3258: mol_type = other RNA
atggataaagggaccaacagcataggttgggctgctctgaggttagatgaacaaggagaaccggtggggataatagaagctggagttaggatctatgcagatggaagagaaccaaagtccggaacatcgttagcagagggtcgaagaatagcaagagggatgtcaaggagaagagatcgatacaaaagacgtagaagaactgtattaaatacattaacagagttcggattgatgccagcaacaaaagcagcaaggaaggcattagtggcagaaacaaatgaccgaagattcggagaagtagccagtaatgtctatgcattgagagcacgagctctagatgaaaaattacctctataccaactaggtagagctttatttcatctaaaccaacgaagaggatttaaaagcaatagaaaaacagataaacgggataatgatcaaggaaaaatagcatcagcaatcagcagactaggtagaaaattagatgaagcaggcgctaggaccttaggagagttcctacataaacagcatgccgctggtaaatgggtacgagtacgcccaagtagagtaccaggagaagatgacaaggaagaagatggatatggattctaccctgaaaggtcatttttggaacgagaatttgcagctatttgggaagcacaagcggctttttaccctgagcttttaacggaggaaagaagagatcatctacactgggtcatgttctttcaaaggccgttaaaaagaccaacggtaggaaaatgctcgtttcacccagacgaggatcgacttccaaaagcacacccactttttcaagaatttcgactaataaaagagttaaacgaactcgaagtagtccatagaggtgatagaagggaaaaacttacaccagatcaaagagacaggttatttaaccaattaagaacacaaagatccagtgcatttacggcattacgtaaaacaataaaagcaccaacaggtacgagatttaataaagaaagtgatgcaagagataaacttaaaggagatgaagttgctgcagaaatgtcacataaggataggtttggtcaagcgtggataggcatgccattagcggaaagatgggcagttgttgcgatgttattggatacagaagatccgttagaagtaaaagcatggcttgaagaaagatacgggttcgcagcagacaggatagatgctatcgctgcagctaaattgccaacaggctacggaagactcggagaaacagcactacgtgatatgttagacgaattaagaaacggaacagtgaaagacgacgccggacgggatgttgtacttacggaacgacaagccatggataacatatggggtgataacccagcattacaaagagcagtaacagatgcgagggagcttccgccctaccaagaagtactaggccgaaggataccgcctggaaccggaaaacccgctgacccttatgacgtccaaaaaggaagactgacaaatcctacagtacatataggactaaaccagttgaaacgaatagtaaatgtattaatgagaagacacggaaggcctgaacagatagctttagaattagctagagacctgaaactcaatgaagaacaaaaagcggagaaaaatcgcgaaatagccaggaacactaaagcagcagaagctaggggaaagaaattagaggaacttgggcacgcaaataatggatataatcgtgtactactaaaactatgggaagacttaaatttaaaacaaccagaaaacagggaatgtatatactgtggtaaagcaatcggaattgggacacttttatcaaaccaagttgatattgaccatatattaccatggagcaaaaccctagatgactctcaagcaaatagaatagtttgtcatgtagaatgtaatagacaaaaaggtaaccacgcaccagcggaagttccacaatggcatgatagatatgacgatattttagcaagggcagaacgattaccaagaaataaagcatggcgatttggacgtgaggcaatgaagaaatttaaagatgatgaatctttcttagcaagacaacttacagatactcagtatttatcaagattggcccatgaatatttaggagcgttgtaccctgatgaggaaccggatgagtggggtggaccagcccgtagaaatcatgtcagggttatacccggacgtatgactgaaatgctaagaagacaatggggtttaaatgcaataatttccgaccataatcagaaaaacagaaatgatcataggcatcacgcaattgacgcaattgttgtaggagtaacaacacgaagattactacaacgaatcgcaacggtagcaggaggacgagaggctctagcgttagaagagacaataggaaaaatagaacctccatggccaggtttctatgacgatgtaaaagcagctatcgacagaatagtcgtatctcataaaccagatcacggttcattaccaaaacccggaaaaccaggtagaacagcgggacaactccataatgatacagcatatggatttactggtgaagcacgtaatggcgtgccgattatggtacaccgtgtaccattcgcatctttgacagaaaaagatataccatcgataagagatagacaattagcagatgcactttatgcggctatatcaggaatatcaggcaaggcagaattggctgcagctctggcaagattcagtgaatctggcccatataaagggattcgtcatgtgcgagttgttgagcccgtctcagtcattgcaattaaagaccaagcaggaaaagcgtacaaaggatataaaggtgatgcaaattacagatatgatgtatgggaactacctaatggaaagtggacgcacgaagttgtgagtatgttcaatgcgcatcgaccagactggcaatcagaaatacgaagtaaaaaccctgcagcaagaaaagttctatcattacatcaaaacgacatggttgcgtacgaacacccacaagacggttatacaatagggagagtagtaaaattttctgctggaggacaaatggcattggcaggaaatagagaagggggagctctaaaaagcagagatgctgatccagaagataggttcagatatttttataaatcagggggagcaatgagagacgtacaattgcgacaagttagagtcgatgaaacaggaagagtttttgatcctggacctcaagatagagagtcgaggaatgcaagaaaacaaaacgacgcaggatga

SEQ ID NO: 5045 - RNA, 3264 nt, synthetic construct
  misc_feature 1..3264: note = Cas9 variant
  source 1..3264: mol_type = other RNA
atgcggtacaaaataggattggatataggaataacaagcgtaggctgggcagtgatgaatttagacatccctaggatagaagatttaggagttagaatatttgacagagcagaaaacccccaaacaggagaatcattagcattaccacgaagactggcaagatccgcgagacgacgcctaagacgaagaaaacataggctagaacgaatacgacgacttgttataagagaaggtatactaacaaaagaagaattagataaattatttgaagaaaaacacgaaatagacgtatggcaacttagagttgaagcactagaccgaaaactaaacaacgatgagttagccagagtcctactacacttagctaaaagaagaggtttcaaaagtaataggaaaagtgagagaagcaacaaagaaaatagtacaatgctaaaacatatagaagaaaacagagccatattatcatcatacaggactgtaggtgaaatgatagtaaaagatccaaaatttgccctacataaaagaaataaaggcgaaaactacactaatacgatagcacgcgacgacctggaaagggaaatcagacttatatttagcaaacaaagagagttcggaaatatgtcgtgcacagaagagttcgaaaacgaatatataacaatctgggccagtcaaagacccgtagcttcaaaagacgatatagaaaagaaagtaggcttttgtacatttgaacccaaagaaaagagagcacctaaagccacctacaccttccagagcttcatagcttgggaacatataaacaaattacgtttaatatcaccttctggagcaagaggattaacagatgaagaaagacgacttctctatgaacaagcatttcaaaagaataaaattacatatcacgacataagaacattactccatcttcctgatgatacttactttaaaggaatagtatacgacagaggagaaagcagaaaacaaaacgaaaatatacgcttcctagaattagatgcataccaccaaattagaaaagccgtagataaagtctatggtaaaggcaaatcttcctcattcttaccaattgattttgatacatttggctatgccttaaccctattcaaagacgatgcagacatacactcatacctacgaaacgaatacgaacaaaatggcaagagaatgcctaatctggcaaataaagtatacgataatgaattgatagaagaattattgaacctttcctttactaaatttggccatctgtccctgaaagctctcagatcgatactaccctatatggaacaaggagaagtatacagcagcgcctgcgaacgagcagggtacacatttacaggccctaagaagaaacagaaaacaatgctactacccaacatacctccaattgccaacccagtagtcatgagagctctaacacaagctcgcaaagtagtcaatgctataattaagaaatatggcagcccagtgagcatacatatagaactagcacgagatctaagtcaaaccttcgacgaaagaagaaaaacaaagaaagaacaagacgaaaataggaagaaaaacgaaacagcaataagacaattaatggaatacggcctcacactcaacccaaccggacacgacatagtaaaatttaaattatggagcgaacaaaatggcagatgtgcttattcattacaacccatcgagatagaacgattattagaaccaggttatgttgaagtagaccacgtaattccttattcacgatcgctagatgatagctatacaaataaagtacttgtactaacaagagaaaacagagaaaaaggtaatcgaataccagcagaatatttaggagtaggaacagaaagatggcaacaattcgagacatttgttctaacaaacaaacaatttagtaaaaagaaacgtgacagactcttgcgtctacactatgatgaaaacgaagaaacagaatttaaaaacagaaaccttaatgatacaagatatatctccagattcttcgcaaattttatcagagaacaccttaaatttgcagaaagtgacgataaacaaaaagtctatactgttaacggaagggtaactgcacaccttcgatcaagatgggagttcaacaaaaaccgtgaagaatcagacctgcatcacgcagtcgatgctgtaatcgtggcatgtacaacacctagcgatatagcgaaagtaacagccttttatcaaagacgagaacaaaacaaagaactagcgaaaaagaaagaaccacattttccacaaccttggccacattttgcagatgaactcagggcacgactatcaaaacatcctaaagaaagtataaaagccttaaacttgggcaattacgatgatcaaaaattagaatcattgcaaccagtattcgtaagtagaatgcccaaaagatcagtaacgggggctgcacaccaagaaaccttaagaaggtacgtaggcatagatgaacgttcaggcaaaattcaaacagtagttaaaacaaaactatcagaaataaaactggacgcatcaggacacttccccatgtatgggaaagaaagtgatccaaggacctatgaagccatacggcaaaggctcctagaacataataacgatccgaaaaaggcttttcaagaacctttatataaaccaaagaaaaacggagaaccaggaccagtaataagaacagtaaaaatcatagataccaaaaatcaagttataccattaaatgatggtaaaacagtagcttataatagtaatatagttagggtagatgttttcgagaaagacggaaaatactactgtgtacccgtatacacaatggatataatgaaaggaatccttccaaacaaagcaatagaaccaaacaaaccttactcagaatggaaagagatgacagaggattatacatttagattctcgttatatccaaatgatctcataagaatcgaactaccacgggagaaaacagtaaaaacagcagcaggagaagaaattaacgtaaaagatgtattcgtttactataaaacgatagactccgcaaacggaggcctcgaattaatttctcatgatcaccgatttagcttacgaggagtgggatctagaacactaaaacgctttgaaaaatatcaagtcgacgtgcttggaaacatatacaaagtaagaggagagaaaagagtcggacttgcttcttcagcacattctaaaccaggaaaaacaataagacccttacaatccacaagagattga

SEQ ID NO: 5046 - RNA, 3264 nt, synthetic construct
  misc_feature 1..3264: note = Cas9 variant
  source 1..3264: mol_type = other RNA
atgctcagaatgaaatacgcaatcggacttgatattggcatcgcttcagtaggctatgcagtgttagccctagaccacgaagagaacccctggggaatcattagactaggaagtagaatatttgatgttgccgaaaatccaaaagatggagcaagtctagctctacctcgaagagaagcaagaagcgtgagacgacgtctaagacgacaccatcatagactagaaagaattaaaaatctactaataaacaccgagttcataacaaaagacgaactgttacatctttatgatggaaacttatcagacgtatacgaactcagagtaaaagctctagactattccgtaacaaatgcggaactgacaaggatattacttcacctagctcaaagacgaggctttaaaagcaatcgaaaaagtgacgccaatgacaaagaagcaggacaattactagaagcagtgtccgctaatgcaaaacgaatgcaagaaaaccattacagaaccgtaggagaaatgttttataaagatgacttattcagtaaatataaaagaaacaagggaggaacatatttaacaacagtacatcgagacatgatagcagcagaagctcgaacaatattagaaaaacaattcgccttaggaaataatatatgtacccaagacttcatagataaatatctatctatacttctaagccaaagacagtttgatgaagggcctggagaaccatccccatatgccggaaatcagatagcaaatatgataggcaaatgtactttcgaaccgaacgaatacagagcagcaaaagcatcctattcgtttgaaaggttcaatttactacaaaaagtaaatcatctccgcctattacttgaaggaaaaagtatagcactagacaacgaacaaagaaagaaaataatagctcttgcccacgacaaagctgaccttagatactcccacataagaaaagccctcggattagacgaaaaagtactatttaacacaataacatataacgacgacgtaagcgtaatagagaaaaagacaaaattcaactttttacaggcttatcaccaaataaagaaagttctagctgaagatatgcaaaaattaacaaccgaacaactggacaatataggacaaatactatcaacatataaaagtgacaataaacgaaccgaagaattatcggcactcggccttgagaagaaaataatagacgcattactaggaataaatggactaagtaaattcgcacatctatcactaaaagcattgagaaagataaatccatatctagaagaaggaaagatctataacgaagcgtgtacagccgctggatatgattttaaagcccatgcaaacactcagaaaacagaactactccccgcatacaaagaagaaatggatgacataacctcacccgtagctaggagggcgatcgcacaatccataaaagtgattaacgcgataataagagaacaaaaaggcagtccactgtacataaacatagaactagcaagagaaatggcaaaaggcttcgacgaaagaacccaaatagacaaagcaaacaaagaaaaccaagccaaaaacgaaagaataatggaaagaataagaaccgagttccataaagccaaccctacaggcatggacttaattaaactaaaattgtgggaagaacaagacggcagaagtccatacagtcaaaaagcaattagtataaacagattatttgaaccaggatatgttgatatagatcacatagtaccatacagtatctcatttgacgactcatttaaaaacaaagtattagtcttttcagatgaaaatcgagacaaaggaaaccgactacctatagcgtacttacaatcaaaatttggcgcaaaagcggcagaaaatttcatgatatgggttcaaagcaacataaaagattataaaaagagacaaaaacttctcaaaagagagataacagaagaagatataaataaatttaaagaaaggaacctccaagataccaaaacaatcagcagattcttatataattatataaacgattacctcctattcgcaccctctgacaccggcaaaaagaaacgagtaacagcagtaaacggaacaatcaccgcatatctacgaaaacgatgggggataaataaaatcagggctaatggagataaacatcatgccgtagacgccgtagtgatagcttgcacaacagacaaaatgattaaagacttaagtagctttagtcgatatcatgaactagagtatacgcacacagacactgaaagtttccttgtaaacagtttaacaggagaaattctaaaaaggtttccatacccgtgggaagactttagacctgaattaatggcccggctatcagataatccagcagacgccttaagaaagctgaatttaatattttatcacggaatcgacctatcaacgataaagcccatctttgtatcaagaatgccccgtcacaaagttacgggagccgcccacaaagctactattaaatcagctagatgcttagacaatggcatcgtcatatgcaaaacatctctacaaaatctaaaactagacaaggaaggcgaaatcgcaaattattatgcacccgaaagcgatacgattctatataatgcattaaaagaaagattaagaagctacgataataaaccagcaaaagcattcgctgagccattctataaacctaaagccgatggaactccaggacccttagtaaagaaagtaaaagtctatgaaaaatcaactcttaatgtcgcagtacaacaaaacacagcagtcgcagacaacgattccatggtgcgagtcgacgtattccacgttaaaggtaacggatactacctagtacccatatatatagcagacacgctgaagaaagaactcccaaacaaagcaatagtagcatataaaccatatgctgactggcccgtaatggacgacagtaatttcatatttagcctttatcccaatgatctaattaaatttgagcacaaaaatagtgtaaaattcgcaaaagttaataaagaaagcacactaaatgatttctactccacaaaatcagaaatagtgtatttcaaaggttgcaacataaacactggtgctatcacaatcataaatcatgagaatacatatgttgtatcatcccttggagtcaaaaccctaccaagtctggaaaaatatcaagcagatgtattaggaaattacacaaaagttaagaaagaagtcagaaaacctttccgatga

SEQ ID NO: 5047 - RNA, 3264 nt, synthetic construct
  misc_feature 1..3264: note = Cas9 variant
  source 1..3264: mol_type = other RNA
atgagatataaaataggattagacatcggaatcacaagtgtggggtgggccgtcatcaatctagacataccaagaatagaagacctaggagtaagaatattcgatcgagctgaaaatccacaaacaggggaatcactcgcacttccaagaagactcgcccgttcagcacgaagaagactcagaagacgaaaacatcgattagaacgaatacgtagattaatcataagggaaggaatactgacaaaagaagaattagataaactatttgaagaaaaacacgaaatagatgtctggcaattaagagtagaagcgttagatcgaaaattgaataacgatgaattagcaagagtactattacacctagctaaaaggagaggattcaaaagtaatagaaaatcagaaagatctaacaaagaaaactccacaatgttaaaacatatagaggaaaacagagcaatcctttcctcatataggacagtcggagaaatgatagtcaaagacccaaaattcgctctacataaaagaaacaaaggagaaaactatacaaacaccattgcccgagatgatttggagagagaaatccggctaatattcagtaaacagagggagttcggcaatatgagctgtaccgaggagttcgaaaacgaatatatcgcaatatgggcatcacaacgccctgtagcgagtaaagacgatatcgaaaagaaagttggattttgtacatttgaacctaaagaaaaacgagcaccaaaagcaacctacactttccagagcttcattgcatgggaacacattaacaaactccgattaataagcccaagcggaactcgaggtttaacagatgaagaaaggcgattactatacgaacaagcatttcagaaaaataaaataacataccatgacataagaacactattacatttaccagacgatacatattttaaaggaatagtatacgatcgcggtgaatcaagaaaacaaaatgaaaacatacgatttttggaattagatgcctaccaccaaatcaggaaagcagtagataaagtatatggaaaaggcaaatcctcatccttcttaccaattgattttgacacattcggctacgctctcacactattcaaagatgacgcagacatacgttcctatctgcgaaacgaatacgaacaaaatggcaaaagaatgccaaatctagcaaacaaagtttacgacaacgagttaatagaagaattactaaatctttctttcacaaaattcggacacctgagcttaaaagcattaagatcaatacttccttacatggaacaaggagaagtatactcatccgcatgcgaaagagccggctatacatttacagggcccaaaaagaaacagaaaactatgctgcttccaaatattcccccaattgccaatccagttgtaatgcgggccttaacacaagcaagaaaagtcgtaaacgcaataataaagaaatacggaagtccagtaagtatacacatcgagctagccagagatttaagccaaacattcgatgaacggaggaaaacaaagaaagaacaagatgaaaacagaaagaaaaatgaaactgcaataagacaactcatggaatacggcctaaccttaaaccccactggtcatgatatagttaaatttaaattatggtcagaacaaaacggcagatgtgcttactcattacaaccaatagaaattgagagactcttagaaccaggatacacagaagtagatcatgtaatcccatattcaaggtcattagacgactcatatactaataaagtattagtactcaccaaagaaaaccgcgagaaaggtaatcgaatacccgcggaatacctaggtgtaggcacagaacgatggcaacaattcgagactttcgttctcacaaacaaacaattcagtaaaaagaaacgtgacagattattaagactgcactatgacgaaaacgaagaaactgaatttaaaaataggaacttaaacgatactagatacatctctaggtttttcgctaacttcattagagaacatttaaaatttgctgaatctgatgacaaacaaaaagtctacactgtgaatggccgagtcacggcccatctacgctcacgctgggaatttaacaaaaatagagaagaaagcgatctccatcacgcggtagacgcagtaatagtcgcttgtaccacgccatcagatatagcaaaagttactgctttttaccaaagaagggaacaaaacaaagaactagctaagaaaactgaaccacatttcccacaaccatggccacactttgctgacgaactccgagcgagactctcaaaacacccgaaagaatccatcaaagctctcaatctaggaaactatgacgatcaaaaattagaaagtttacaaccagtattcgtatccagaatgcctaaaagatcagtaacaggcgccgcccaccaagaaacattacgcagatatgtaggtattgatgaaagatcaggtaaaattcaaaccgttgtcaaaacaaaattatccgaaatcaaactagatgcatcaggacattttccaatgtatggaaaagaatcagatcctagaacgtatgaagccataagacaaagactactagaacacaataatgaccccaagaaagcatttcaagaaccactatacaaaccaaagaaaaacggagaaccagggcctgtaatcagaacagtcaaaataatagacaccaaaaaccaagttattccattaaacgatgggaaaacagtagcctataattcaaatatagtacgagtcgatgtattcgaaaaagacggaaaatattactgcgttccggtatatacaatggacataatgaaaggaatcttacccaacaaagctattgaaccaaataaaccatactccgaatggaaagaaatgacagaagactacacattccgatttagtctatacccaaacgatcttataagaatcgaattaccaagagagaaaataatcaaaaccgcaggcggggaagaaataaaaataaaagatctattcgcatattacaaaaccattcactcaggcacagcaggcctagaattagttagccatgactgcagtttttcactcagtggtgtaggcagtcgcacactaaaacggttcgaaaaataccaagtcgatgtcctagggaatatttataaagtacgcggcgaaaaacgcgtcggacttgcaagtagcgcccattcgaaaacaggagaaacaatccgaccacttcaaagcactagggattga

SEQ ID NO: 5048 - RNA, 3264 nt, synthetic construct
  misc_feature 1..3264: note = Cas9 variant
  source 1..3264: mol_type = other RNA
atgcgatataaaataggactagacataggtataacatctgtcggctgggctgtaattaatcttgatttacctagaatagaggacctaggtgtccgtatatttgaccgagctgaaaaccctcaaacgggagaaagtttagcattaccaagaagactcgccagatctgcaagacgtagacttagacgacgtagacacagactagaaagaataagaagactcctcacgagggaaaatgtgttaacacaagaagaacttgacaaactatttgaaaaaaaacacgaaatagacgtttggcaacttcgcgtagaagcattggatagaaaacttaataatgacgaattagctagggtgctcttacatctagcgaaaaggagaggtttcaaatcaaatagaaagtcagaaagaagcaataaagaaaacagcactatgttaaaacacatagaagagaatcgatccatattaacaggataccgtactgtgggagaaatgatagtaagggacccaaaattcgtgctacataaaagaaacaaaggcgagaactatactaataccattgcaagagacgacctagaacgagaaatacaactaatctttgctcgccagcgtgaatttggtaatatgatatgtacggaggcattcgaaaacgaatatatagcaatatggagtagtcaaagacccgtcgcatctaaagatgatatagaaaaaaaagtaggattttgcacttttgaaccaaaagaaaaacgagctcccaaagcaacctacacatttcaatcatttatagcatgggaacacatcaataaactacgactagtaagtccaagcggcacacgcgaactaaccgacgaagaaagacggttactttatgagcaagcgttccaaaaaaataaactaacctaccacgacatcagaaccctcctacatctaccagacgacacatacttcaaaggtatcgtgtacgattggggagaacctctgaagcaaaacgaaaatataagattcttagaattggatgcatatcaccagatacgtaaaacagtagacaaagtgtacggccgcggaaaatctagctcatttctacctatagattttgatactttcggatacgcactaactttatttaaagacgatgcacatatacgttcatacctaaggaatgaatatgagcaaaacggcaaaagaatagcaaacctggccaacaaagtatacgacaatgaactaatagaagaactcctaaatctatcatttacaaaattcggccatttaagtttgaaagcactaagaaacatattgccatatatggagcaaggcgaagtatatagttctgcatgcgaaagagcaggatataccttcacaggacctactaaaaaacaaaaaactgtccttctacctacaataccacccatcgcaaacccggtcgtaatgcgcgcactaacacaagcaagaaaagtggtaaatgcaataatcaaaaaatatggttctccagtaagtatccatatagaattagcacgtgacttatcacaaacattcgatgaaaggaaaaaaacaaaaaaagaacaagacgagaataggaaaagaaatgaaacagcgataagacaactgatagaatatggactaacacgcaatccaacaggacacgatatcgtaaaatttaaactatggagcgaacaaaatggaaggtgtgcttattcactacaacccattgaaataaaaagactattagaaccaggctacgtggaggttgatcacgtaataccttattcacgatcactggatgattcatacaccaataaagtgctcgtacttacaaaagaaaacagagaaaaaggaaaccgtatacctgcagagtatctaggagtgggcacagaaagatggcaacaattcgaaacatttgtcctgacaaacaaacaattcagtaagaaaaaacgagatagattactacggttacactatgatgaaaacgaagaagctgaatggaaaaacagaagcctcaacgacactaggtacatatcaagattttttgctaatttcataagggaacacttaaaatttgctgattcagacgacaaacaaaaggtatacactgttaacggcggagtcacagcacacctacgatccagatgggacttcaataaaaacagggaagaaagcgatttacatcacgccgtagatgctgctatagtagcttgcacaacgctatctgatattgcaagagtgacggcattctaccaacgaagagaacaagctaaagagctagcgaaaaaaacagaaccacactttccacaaccatggccacacttcgcagacgagctaagggcacggttatcgaaaaacccaaaagagtcaataaaagcactaaacctaggcaattacgacaacgaaaaacttgaatccttgcaaccagtgtttgtaagtagaatgccaaaaagaagcgtaacaggagcagctcaccaagaaactctaaggaggtacattggaatagatgaaagaagtggtaaaattcaaacggttgtaaaaactaaattaagtgaaatcaagctagatgcatctggacatttcccaatgtatggaaaagaatccgatccaagaacctatgaagcaataagattacgcctactagaacacaacaacgatcccagaaaagcattccaggaaccattatataagccaaaaaaaaacggagaacttggacctataattcgtacagtaaaaataattgatacaaaaaatcaagtaatacccttaaacgatggcaaaacggttgcatataacagcaatatagtgcgcgtagatgtgttcgaaaaagatgggaaatactactgtgtgcccgtatatacaatggacattatgaaaaaagtcctgcccaataaagcaatagaaccaaataaaccatactcggaatggaaagaaatgacggaagactacacattccgattttcattataccctaatgatttaataagaatagaattaccaagagaaaaaacagtaaaaacaacagcagggcatgaaataaatattaaagacgtatttgtttattacaaaacgatcgactcagcaacaggaggcctagaactcattagtcacgacaattcgttcagcttaagaggtatcggctcccgcacattaaaacgattcgaaaaataccaggtcgatgtattaggaaatatctacaaagtccgaggtgaaaaaagagtgggacttgcgtcttccgcacatccggagacaagagaaactattagaccattacaatccacacgagattga

SEQ ID NO: 5049 - RNA, 3264 nt, synthetic construct
  misc_feature 1..3264: note = Cas9 variant
  source 1..3264: mol_type = other RNA
atgaaaaaactagtcctaggcctggatataggtgtagcatcagtaggctgggggatcatcgacgcagaaaatggagacgttgtagacacaggagtcaggctattcagttcaagagacgcgtccgaaaatgaatccagaagaacaagccgacaatccagacgactttcgcgaagaaaaaaacacaggagggaaagaataaaacaattactcctggcccatgacatggacatatgcgacatagtaaacgaaaacccatacgaactccgagtaaaaggccttaacgaaaaactagaagtatcagaaatctacgtagcactaacccacctggctaagcgaagaggcgtcagttatctcgacgatgtcgtggaagagggtggaacaataaaaagcgaacacttaaacaaaaatatggaagaaataaaatccggcaagatgccttgtgaaatacaactagaacgatttgaaaaatatggacaagttagaggaatgatagaaataaaccaagacactgaagaatcatcattcctagtaaacatattcagaacatcagactatattaaagaagctaaaacaatcctagcaacacaacaaaaatttcacaaacaaatcaccaatgaattcattgacgaatatatccacattatggcctcaaaaagagactacttcataggtccaggaaacgaaaaaagccgaacagactacggagtgtacagaactaacggcgacacatgggacaacttattcgaaattttaataggaaaatgttcagtattcccagaagaaactagagctgctagaagtagttatgtagctcaagaatttaatctgctaaacgatttaaacaacctaaaaatatcgaatctcgaaagtggaaaactatctgccagtcaaaaacacgacatagtagaaaaagtaaaaaactctaaaaaattcggaacaaaagatcttctaaaatacattgcctcagtatgcgaatgcaaaatagaagatataggtggctgccgcgttgacaaaaatagaaaaccaataatgcatacctttgaaaattacagaaaagttcataacgcacttaacgaagcaggcgtcgacttaagactatccgaaacagattacgacgaattgatgaaaattatgacccttaacagtgagaccttagaaataaaaaagcaatgtaaagaaaagctaccacaactaacagaagattatttaaacgtgtgtttggtcttaaataaaaaaggcgccttcagcggctggcacgcgctatctttgaaagcaatgaaattaatgatgcctgaattatacggaacgtcaaaaaaccaaatgcaaataatacacacaatgcagttagggaaagcctatctaaaacccctcaatcaacaaaaatacctaaattcagaggccatattagaggaaatatacaacccaattgctgcaagatcaataaggcaaacaataaaagttacaaatgcaatactaaaaaaatatggacatctagacagcgttataatagaaatgcctcgagattatcaaaccagtgaagacgaacgaaaaatgatagaaaaaatgcaaaaagaaaacgaaaaagaaaagaaagcggctctgaaaagagcgagagaggagtatccatttccagacgaagcatttagaaatcacaaagaactcgctaccaaattaagactttggtaccaacaggatcaattctgtgtttattctggacgaaaaatttccgttgtcgacctcgtaagaaacccaaatcaattcgaaattgatcacataatacctcaaagtgtatccttagacgatagtttaaacaacaaagtattatgctttagtgaagaaaaccaaaagaaaggacaacaaacacctttttattaccacaagggcaaaagcggtaactggacgtacgaacaatacaaactattcgtagaaaaactattcgataaaaaaaaaataagtaacaaaaaaagagaattacttctattcgaagaagacataaataaatgggatgtaagaaggggatttatagcacgaaacttagttgacacacgatacgcatcaagagtgatactcaacagctaccaacaatatttcggaaatcatgaaatgggaacaaaagtcaaagtcgttagaggtaaatttacgtcccaacttagaaaaaaatggagaatcttcaaagatagaaatgaaagccactcacaccacgcaattgacgccctaatagtagctgcaacagctaacctaagactatggaaaaaaaatacactaggtgtaagcgacgaaggcaaagtttacgataaggaaacaggagaaattttaccattcgaaaaactaactgaaagtgaatataacgaaatgatgaacaaagaaccatacctaaattttaaaaccaaacttcaaaatatagaaacaaaagtaaaatatagctacagagtatcaaaaaaagtaaatagaaaaatctcagatgccacaatttatagtacacgagaaagagatggcatcgactatatagtaggaaaaataaaaaacatttatgacgtaaaaacctacaaagaccaattcctaaaacgctacaaaaaaaacaaagagcaattcttgatgtatcaacatgatccacaaactttcgcaatactcgaaaatattatggcgacataccaggacgcagaaaacccattcttagcatacaaaaaggaatacggggttataaggaaatactccaaaaaaggtgggggttctccagtaacctcactcaaatttatagacaaagtactaggacaaaaaatagatctcaccgcaaaaaaccaggccgcattacctaaaaacaaaaaagtagtattacaatcaataacaccatacagagcagacgtatactatgacgaaattgacaagagataccacctaataggagttaaatactcactgttttccttttcgaaacaaggttacgtaatcaaccctattgcgtaccaaaaattgttagagaaagaacaaatacactcagagatgaaattttgtttcagcttatacagagaagacataatagaatttggtgaagacccagactccctcacaagatacaggttttggtctaaaaacgagagcggcaaaaacaaaatagaagtaaaacctatcgaaaaaccgaattttgagaaacaaacagtactcaccatcactaaaaaaatcaaaatcttgaacaaataccaaacagatgtcttagggaactcttttaaagctcaagaagaaaaagacccaagaaatatcgaatga

SEQ ID NO: 5050 - RNA, 3264 nt, synthetic construct
  misc_feature 1..3264: note = Cas9 variant
  source 1..3264: mol_type = other RNA
atgaggtataaaataggattagatatcggcataacctcagtgggttgggctgtaatgaacttagacatacccagaatagaagacctaggggtaagaattttcgacagggctgaaaatccacaaaccggggaatccctagcactaccccgaagactagcaagatcagcacgcagaagactgagacgacgtaaacatagattggaaagaataagaagattagtcataagagaaggaatactgactaaagaagaattagacaaactcttcgaagaaaaacatgaaatcgacgtatggcaactaagggttgaagccctcgaccgtaaacttaataatgatgaactagcaagagtgctattacatctagctaaacgacgaggattcaaaagtaacagaaaaagcgaaagaagcaataaagaaaactcaacaatgttaaaacacatagaagaaaatagagctatactttcatcctacagaactgtaggagaaatgatagtaaaagatcctaaattcgctttacacaaaagaaacaaaggagaaaattacacaaatacaatagcacgagatgatttagaaagagaaataagacttatcttcagtaaacaacgagaatttggaaacatgtcttgcacagaagagtttgaaaatgaatatataactatatgggcctctcaaagaccagtcgcttcaaaagatgacattgaaaagaaagtaggattctgtacattcgaacctaaagagaaacgagccccaaaagcaacctacaccttccaatccttcatagcttgggaacacatcaataaattacgactaatatcaccgagcggagctagaggtctaacagacgaagaacgacggttactatacgaacaagcatttcagaaaaataaaataacctatcacgacatcaggactttattacacttacccgacgatacatattttaagggaatagtttacgatagaggcgaatcaagaaaacaaaatgaaaacatacgattcctcgaattagacgcgtaccaccaaattcggaaagcagtagataaagtttacggcaaaggtaaaagctccagctttctaccaattgatttcgacaccttcggatacgctctcacactgttcaaagacgacgccgatattcattcttatttaagaaacgaatatgaacaaaacggaaaacgaatgccaaacctagcaaataaagtctatgataacgaactaatagaggaacttctaaatctgagtttcacaaaatttggacacttaagtctaaaggctttaagatcaatattaccgtacatggaacaaggagaagtctactcttcggcatgtgaacgcgccggatatacatttacgggcccaaagaagaaacagaaaactatgttattaccaaatatacctccaatcgctaacccagtagtcatgagagccctaacgcaagcacgtaaagtagtaaatgctataattaagaaatacggctcaccagtatcaattcatattgaactcgcacgtgatctctcacaaactttcgacgaaagaaggaaaactaagaaagaacaagacgaaaacagaaagaaaaatgaaacagcaatccgtcaattaatggaatatggattgactctaaatcctacaggacatgacatagtaaaattcaaactatggtccgagcaaaatggaagatgtgcgtattccttgcaaccgattgaaatagaacggctcctagaaccaggatacgtagaagtagatcacgtcataccttacagtagatctttagacgacagctatacaaataaagtgcttgtcttaacaagagaaaatagagaaaaagggaaccgaatacctgccgaatatttaggagttggaactgagagatggcagcaattcgaaacttttgtattaacaaacaaacagttctctaaaaagaaaagagatagactactaagattacactacgacgaaaatgaagaaacagagttcaaaaacagaaatttgaacgatacaagatatatttcaagattctttgccaactttattagagaacacctaaaattcgcagaatcagatgataaacaaaaagtgtacacagtcaacggacgagtaactgcccatctcagatccagatgggaatttaataaaaaccgagaagagagcgatcttcaccacgcagtggacgccgcaatagtggcatgcaccactccctcagacatagcaaaagtaactgcgttctaccaacgacgagaacaaaacaaagaattagcaaagaaaacggaaccacacttcccacaaccctggccccactttgctgacgaattaagagcaagactttcaaaacatccaaaagaaagcataaaagcacttaaccttggaaactacgatgaccaaaaactcgagagcttacagccagtatttgtatcaaggatgcccaaaagatcagtaactggagcagcacaccaagaaacattacgaagatatgtaggcatagacgaacgaagtggaaaaatccaaacagtggtaaaaacaaaactgtctgaaataaaactagacgctagcggtcacttccctatgtacggtaaagaatctgacccaagaacatacgaagcgataagacaaagattactagaacacaataatgaccccaagaaagcctttcaagaaccattatataaaccgaagaaaaatggagaaccaggtccagttattcgaacggtaaaaataatagatactaaaaatcaagtcattccattaaatgatggcaaaacagtagcatataatagcaatatcgtaagagtcgatgtattcgaaaaagacggcaaatattattgcgttccagtatacaccatggacataatgaaaggaatactaccaaacaaagcaattgaaccaaataaaccatatagcgaatggaaagagatgacagaagactacacctttagattttccctctaccccaatgaccttataagaatcgaattaccacgagagaaaacagtcaaaacagcagccggtgaagaaatcaacgtaaaagatgttttcgtatattacaaaactatagattcagcaaacggaggattagaactaatctcccacgaccatagattctcactaagaggagtaggatctagaacgctaaaaagatttgaaaaatatcaagtagatgtcctcggtaacatttacaaagtacgcggagagaaaagggtaggacttgcatcttcagcacacagcaaaaccggtgaaacagtgagacccctacaatccacacgcgactga

SEQ ID NO: 5051 - RNA, 3264 nt, synthetic construct
  misc_feature 1..3264: note = Cas9 variant
  source 1..3264: mol_type = other RNA
atgagatataaaataggattagatataggtataacatcagtaggttgggcagtcatgaacctagacatacccagaattgaagatttaggcgtaagaatatttgaccgagcagaaaatccccaaacaggggaatctttagccttacccagacgattagctagatccgccagaagaagacttcgaagacgaaaacatagactagaacgaatcaggcgtctagtcatccgagaaggaatacttacaaaagaagagttggataaacttttcgaagaaaaacacgaaatagacgtctggcaattaagagtcgaagctctcgataggaaactgaacaatgacgaattagcacgagtactactacatctagcaaaaagacgaggttttaaatctaatcgtaaatcagaaagatccaataaagaaaacagtacaatgctaaaacacatagaagaaaaccgagctatactatcaagttatagaacggtaggtgaaatgatagtcaaagatccaaaatttgccttacacaaaagaaacaaaggggaaaattatacaaacacaatcgctagagatgatctagaacgagaaataagattgatattctcaaaacaaagagaatttggaaacatgagctgcacagaagaatttgaaaacgaatatataactatctgggccagccaaagaccagtcgcatccaaagacgacatcgaaaagaaggttggattctgcacattcgaaccaaaagagaaaagagcacctaaagcaacttatacctttcaatcatttatagcttgggaacacataaacaaattaaggctcataagcccatccggtgcacgcggactcacagatgaagaacgcagactactctatgaacaagccttccagaaaaataaaataacataccacgacatcagaacgttactacacttaccagatgatacctattttaaaggaatagtttatgacagaggagaatccagaaagcaaaacgaaaatatcagatttctcgaattagacgcataccaccaaataagaaaagcagtagacaaagtatacggaaaaggcaaaagcagctcctttttaccaatagacttcgacacgtttggatatgctctaactttatttaaagacgacgcagatatacactcttacttgcgaaacgaatatgaacaaaatggaaaaagaatgccaaatctggctaacaaagtatacgataacgaattaatcgaagaactattaaacctctcattcacaaaatttggacaccttagtcttaaagcacttagatcaatattgccatacatggaacaaggagaagtctactcttcagcatgtgaacgagcaggatacacattcacaggtccaaagaagaaacagaaaactatgctactcccaaacataccaccgatagcaaacccagtagttatgagagcactaactcaagctcgaaaagtagtaaatgcaataattaagaaatacggaagcccagtatccatacatatagaactagcaagagacctgagccaaacattcgacgaacgccgaaaaacaaagaaagaacaagatgaaaataggaagaaaaacgaaacagctatccgacaattaatggaatacggcttaactttaaatcctaccggtcacgatatagtcaaattcaaactttggtccgaacaaaatggacgatgcgcatattccctacaacctatagaaatagaacgactcttggaaccaggttatgtagaagttgaccatgtaatcccatacagcagatcattagatgactcctacaccaataaagtcctagtattaactcgcgaaaacagagaaaaaggaaacagaataccagccgaatacttgggtgtaggaactgaacgatggcaacaatttgaaacattcgtactcactaataaacaattctcaaagaagaaaagagatcgcttacttcgcctacattatgacgaaaatgaggaaaccgaatttaaaaatcgaaatctaaatgatacaagatacatatcacgtttctttgctaactttataagagaacacctaaaattcgccgaaagcgacgataaacaaaaagtatacacagtaaatggtagagtcacagctcacttaagaagtcgatgggagttcaataaaaatcgagaagaaagtgacctacatcacgcagtagacgcagtaatagtcgcttgtactaccccaagtgatatagcaaaagtaacagctttctatcaaagaagagaacagaataaagaactcgcaaagaaaacagaaccccattttccacaaccatggccgcactttgcagacgaactaagggcaagactatcaaaacatccaaaagaatctataaaagcactaaacctaggaaattacgacgatcaaaaactagaatcattacaaccagtgttcgtctcaagaatgcctaaaagatctgtcaccggtgccgcacatcaagaaacactaagaagatacgtaggaattgacgaaagaagcggaaaaattcaaaccgtagttaaaacgaaattgagcgaaattaaattggacgctagcgggcactttcccatgtacggcaaagaatccgaccctcgaacttacgaagctattagacaaagactgctggaacataacaatgaccccaagaaagcatttcaagaaccactatacaaaccgaagaaaaatggagaaccaggaccagtaataagaacggtgaaaataatagacaccaaaaatcaggtcatcccattaaatgatggaaaaacagtagcatataactcaaatatcgtaagagtagatgtatttgaaaaagacggaaaatactactgcgtacctgtttatacaatggatataatgaaaggaatcttaccaaacaaagcaatcgagccaaacaaaccctactcagaatggaaagaaatgacagaagattacactttcagattcagcctctatccaaatgacctaataagaatagagctacccagggagaaaaccgtgaaaacggcagcaggagaagaaattaatgtcaaagacgtcttcgtttactacaaaacaatcgacagcgcaaacggtggcctagaattaatatcacacgatcaccgattttcacttagaggagtaggaagccgtacactaaaacgatttgaaaaatatcaagtggacgtactcggaaacatatacaaagtacgcggagagaaaagagtaggactagcatcatctgctcattctaaaccaggaaaaacaattcgacctctccaatctacgagggattga

SEQ ID NO: 5052 - RNA, 3264 nt, synthetic construct
  misc_feature 1..3264: note = Cas9 variant
  source 1..3264: mol_type = other RNA
atgcgatataaaataggactcgatataggtataacaagcgtagggtgggcagtaataaatttagacataccgaggatcgaagacttaggggtacgcatatttgacagagccgaaaatccgcagaccggcgaatcgctagcacttccaaggagactagctagatctgcaagacgaagactacgaagaagaaaacacagactagaaagaatacgaaggctaataatacgcgaaggaatattaaccaaagaagaattagataaactctttgaagaaaaacatgaaatagatgtgtggcaactaagagtcgaggctttagataggaaattaaataacgatgaactagcacgagtcttattacatttagccaaaagaaggggatttaaaagtaacagaaaatcagaaagaagtaacaaagaaaattccactatgctaaaacatatcgaagaaaatagagccatcttatccggttacagaactgtaggtgaaatgatagtaaaagatccaaaatttgccttacataaaagaaataaaggagaaaattacacaaatacaatagcaagggatgatctagaacatgagataagattaatattctctaaacaacgcgaatttggaaacatgtcatgcacggaaaaattcgaaaatgaatatattacaatatgggcatcgcagagaccagtagccagtaaagatgacatagagaaaaaggtcggattctgtactttcgaaccgaaggaaaaacgtgcgcctaaagctacctacacttttcagagcttcatagcatgggaacacattaataagctaagattaatattcccatcaggcgcaagaggactaacagacgaagaaagaaggctattatatgaacaagcattccaaaagaataaaataacgtaccatgatatcagaacgctactacatttaccagatgacacttacttcaaaggtatagtatatgatagaggagaatctagaaaacaaaatgaaaatataaggttcctagaattagacgcatatcatcaaatacgaaaggccgtggacaaagtatacggcaaaggaaaatcaagcagttttcttccaatcgattttgacacatttggttatgcattaactctctttaaagatgacgctgacatacattcttacctaagaaatgaatacgaacaaaatggaaaaaggatgccgaatttagccaataaagtatatgacaatgaattaatcgaagaactattaaatttatccttcactaagtttggacatttaagtctaaaagcactaaggagtattctaccctacatggaacagggagaggtgtacagctcagcgtgtgaaagagcaggatatacgtttaccggccctaaaaagaaacaaaagacaatgctactaccaaatataccaccaattgcaaacccagtggtaatgagagccttaacacaagcaaggaaagtagtaaacgcaataatcaagaaatatggtagcccagtaagcatacatatagaactagcacgagacctatcacaaacctttgatgaacgtcgtaaaacaaagaaagaacaagatgaaaatcgtaagaaaaacgagactgccataaggcaactaatggaatatgggttaacgttgaacccaacaggacatgatatagtaaaattcaaactgtggtcagaacaaaatggacgatgtgcttatagtttacaaccaatcgaaatagaaaggctattagagcctggctatgtagaagtcgaccacgtaataccatatagcaggtcactagatgacagttacactaataaagtcctagtcctaacaagagaaaatcgagaaaaaggaaacagaataccagctgagtacctgggagtaggaacagaaaggtggcagcaatttgaaacatttgtcttgacaaacaaacaattttcaaagaagaaaagagataggctattaagactacactacgacgaaaatgaagaaacagaatttaaaaatcgtaacctaaatgacaccagatatatatcaagattctttgccaatttcatacgtgaacacctgaaatttgctgagagcgatgacaaacaaaaagtttataccgtaaacggacgagtaacaagccaccttaggtcaagatgggattttaacaaaaatcgagaagaatcggaccttcatcacgctgtggatgcagcaatagtagcatgtactacaccttcagacatagcaaaagtaacagctttttatcaaagaagggaacaaaataaagaactcgccaagaaaacagaaccacattttccacaaccatggccacattttgcagacgaactacgcgcacggcttagtaaacacccaaaagaatcaattaaagcactaaaccttggaaactatgatgaccagaaactagagagcctccaacccgtatttgtgtcaagaatgcctaaaagaagtgtgactggagccgcacatcaagaaacactacgacgatacattgggatcgacgaacgatcaggcaaaatacaaacagtagtaaaaactaaattaagtgagataaaactagatgccagcggacattttccaatgtacggtaaagaatctgacccaaggacctacgaagctataagacagagattactagaacataataatgaccctaagaaagcatttcaagaaccgctgtataaacccaagaaaaatggagaacctggaccgataataagaacagtcaaaataatcgatactaaaaaccaagtaataccacttaatgacggaaaaacagttgcgtacaattctaatatagtgagagttgatgtatttgaaaaagacggaaaatattattgtgtaccagtttatactatggacataatgaaaggtatactgccaaataaagcaattgaacctaataaaccatacagcgaatggaaagaaatgaccgaagattacacatttcgatttagtctataccccaacgacctaataagaatagaactaccaagggagaaaacagttaaaaccaccaccggagaagaaataaacgtaaaagacgtctttgtatattataaaaccatagattcagcaacagggggactcgaattaataagtcatgataaccgctttagtcttagaggtgtaggatccagaacattaaaaagattcgaaaaatatcaagtcgacgtactaggaaacatatacaaagtaagaggagagaaaagagtaggacttgcatcaagtgctcactccaaaacaggtgaaacaataaggccactccaatccactagggattga

SEQ ID NO: 5053 - RNA, 3264 nt, synthetic construct
  misc_feature 1..3264: note = Cas9 variant
  source 1..3264: mol_type = other RNA
atgcgatataagataggattagatataggcataacaagtgttgggtgggcagtaatcaatttggacataccgaggattgaagatctgggtgtacgcatattcgatagagcagaaaatccacaaactggcgaaagtctagcattacctagacgactagccagaagcgccaggcgaagattacgacgtagaaaacaccgcctagaaagaataagaagattgctgataagagaaggagtcctaacaaaagaagaactagacaaacttttcgaagaaaaacacgaaatcgacgtatggcaactaagagtagaagcattagacagaaagctaaataacgatgagctagtcagagtcttactacacctggctaagagacgtggattcaaaagcaataggcaaagtgaaagatccaacaaagaaaatagcacaatgctcaaacatatagaagagaacagggccatactgtcagggtacagaactgtcggagaaatgatagtaaaagatcccaaattcgcattacacaaaagaaacaaaggagaaaattacactaacaccatagcaagagacgatttagaacgcgaaattcgattaatattctctaaacaaagagagttcggaaatatgagctgtactgaagagttcgaaaacgagtatatagcaatctgggcctcacagagacctgtagcaagcaaagacgacatagaaaagaaagtaggattctgtacgttcgaacccaaagagaaaagggcgccaaaagccacttatacattccaaagtttcatagcatgggaacatataaataaactaagattaataagtccatcaggaacacgagggttaacagacgaagaaagaagactactgtacgaacaagcatttcagaaaaacaaaataacatatcacgacataaggacacttctacacctaccagacgacacatattttaaaggaatcgtatatgattggggagaatctctcaaacaaaatgaaaacataagattcctagaattagatgcatatcaccaaatacgaaaagcaatcgataaagtatatggcaaaggaaagtcgtcttccttcttgcccatagacttcgacaccttcggatatgctttaaccctatttaaagatgacgctgacatcagatcatatctacgaaatgaatatgagcaaaatggcaaaagaattgcaaacctcgcaaacaaggtttatgacaacgaactgatagaagaactcttaaacctatcgtttaccaaattcggtcatctctcccttaaggctttgaggaatatcctaccttatatggaacaaggagaggtttactcaagtgcatgcgaaaaagcaggatacaccttcacgggaccgaaaaagaaacagaaaactgtactcctcccaaccattccaccaatagtaaatccagtcgtaatgcgagcactaacacaagctcgaaaagtcgtcaacgctataataaagaaatatggatcacctgttagcattcatatagaactagcaagagacttaagccaaaccttcgatgagagaagaaaaacaaaaagagaacaagacgagaaccgtaaaagaaacgaaacagcaataagacaattaatggagtatggtcttactttaaatccaactggattggacatagtcaaatttaaattatggtcagagcaaaacggacgatgcgcatattcgctccaaccgatcgaaatcgaaagactacttgaaccaggttatgtagaagtggatcacgtcattccatactctagatcattagacgactcatatacaaataaagttctagtactgactaaagaaaaccgagaaaaaggcaacaggattcctgcggaatacctaggagttggaactgaaagatggcaacaatttgaaacatttgtattaacaaacaaacaattctccaaaaagaaaagagatcgactactcagactacattatgacgaaaatgaagaaatggaatttaaatcacgaaacctcaacgacaccagatatatttcaagattctttgctaactttataagagaacacctaaaattcgctgaatcagacgacaaacaaaaagtatatacagttaacggtagagtaacatcacacttaagaagcagatgggatttcaataaaaatagagaagaatcagatctccaccatgccgtcgatgctgcaatagtggcctgcaccaccccatcagatatagcaaaggtaacagcattctaccaacgccgcgaacaaaacaaagaacttgcaaagaaaaccgaaccacaattcccacaaccatggcctcatttcgccgacgaattacgagcaagacttagcaaacatccaaaagaatcgataaaagcactaaatttaggaaactatgacgatcaaaaacttgaaagcctacaaccagtgttcgtatcaagaatgccgaaaagatctgtaacaggagctgcacaccaagaaacactaagaagatacataggtatagatgaaagatctggaaaaatccaaacggttgtcaaaacaaaattaagtgaaatcaagctagacgcatcaggtcacttccctatgtacggaaaagaaagtgaccctagaacatacgaagctataagacagaggttattagaacataacaatgacccgaagaaagcctttcaagaaccgctttataaaccaaagaaaaacggggagccaggaccaattataagaacagtcaaaataatagacaccaaaaaccaagtaattccactgaatgacggaaaaacagtggcatataacagtaacatagtaagaatagacgtattcgaaaaagacggaaaatactactgcgtaccagtttacaccatggacataatgaaaggagtactgccaaacaaagcaatagagccaaacaaaccctactctgaatggaaagaaatgactgaggattacacatttcgatttagcctttaccctaatgatcttatcagaatagaattgccaagagagaaaacagttaaaacagccgcaggagaagaaataaatattaaagacatgtttgtgtattacaaaacaatagacagcgccaatggaggattagaactcatctcccacgacaattcattttccttaagaggcgtaggatcacgaacgcttaaaagatttgaaaaatatcaagtagacgtactaggtaatatatacaaagtaagaggagagaaaagagtaggcctagcttcatcagctcattcaaaaaccggagaaactataagaccactccagtctacaagagattga

SEQ ID NO: 5054 - RNA, 3267 nt, synthetic construct
  misc_feature 1..3267: note = Cas9 variant
  source 1..3267: mol_type = other RNA
atgccaaaagaattcgacccacttaagcccgcaaaatacagattggcattagacatagggagcaaaagtataggattcgctataatatttctaaaagaagatgtcaacaaactacttaaaccttacgcaatagtcagaagcggtgttagaatattcggggacggtaggactccagctgcaccaggacagcttggcagcagtctagcagcagaaagacgagttaaaaggagcatacgacgacaatatgcgagaaaacgaaaaagattacaaagactgcttcgaaacctaaaggaactaggtttctttccagatgactctaaactgtgcaaatcatttgaagatctaaatccatatgaactacgacataagggccttactaaagagttaaaaccccatgaatttggaagactcctaatgcacatggctaaaaatcgtggattccagtcaaacagaaaagtagacttactagcagacaatatagactcacaagcaaaagcagaaactagtgcaatgaagagcgcaatagcaacactacagagtcggttaaacggagaatttgaaactttaggcgcatatttatacgaacgatttaaaaaaggagaaactataaaatcaagtaaaacgcaaaaaggccaaaaagcggaatatgaattctcaatttcaagaagaatggttaaacaagaattcgatcgactatgggctgcccaagaacaattcaatccagaactttttaacgagcaggctaaaaataccttaaaagacactatatttttccaaagaaacctcttaccacaaaaagtcggaaaatgcaccttcttgccagagcatgaacgagcatctaaggctctcccttcatcacaatactttcgaataatctcagaacttaacaagatcagttttaccgacgccgaagggcttatattaccaataagcctagaacaaagaaacaaactactgaaatcacttcgaataaaacaaaaattaagttttgacagaatacgaacggaactaaatttagactcaacagtattaataaatcttgaacacgcttcaaaggattctatcgaaggagacaaaacaggatatttactatctaaaaaagagtactttggaccggcctggagagacttatcactagaaacacaagacgccattgtaactgcactgctcacccacgaaaacgaagcagaacttgtacagaaactcgtcgatgatttcaacatagcacatgacgttgcaaaagcccttgccaatgctagattagaatcacaatatatgagattaagcaaagaagccatagaaagattaatcccagaattagaaaaaggtgtggactcccaagatggatacaaagtaccggtgaaatatcatgaggcaacagaggcagccggttttggacaccatagcgcattacaagaaaattgggctgattttccgaccctagatctaaaacaactacattcagacgataacgacaaatacaccgttgcagaactaccgttaccatactatggaaaagtaattacacgccaagtcgctttcggaaccggagacgtaaatgatcccgttgaaaaaagatttggaaaaattgctaatccgacagttcatatttgtttaaaccaagtacgtgtactgttagatgagattatagctaaatatggttacccatatgaggtaaatattgaactagcacgagaactaaaacaaaaccatgaacaacggcagagaagtataaaacaacaagccgcaaataaaaaagaaaacgaagaaatccgaagagaaataaaacaagcgtacaaagttgaaaaggcaagaataataacagattcagagattagccgggccgatatagaaaaatggagattatggagaagaagtaaaagtaagctatgtgtatattcagggaaaaaaatatgcgaaacaatgattttaaacaatgaagtagaggtcgaccatatactacctaggagtagaactggagacaactcatatcaaaacaaagtactcgttctaaataaagcaaatcgaatcaaaagtaacagaactccgtgggaagcaaaggaactatttgaagcacagggatggtcatacgaagacatattaaatagaatgcgagcactcgataaacaccaactattcagattcgccgaaaattccatggacatatgggataaaaactatcgatcctttgaagcaagagcactaaatgataccagatacataagtagagtagtaaaagattatctaaaagtagtatgccataaagaccgaatcgtcgttagcaatggcgctcacacagccctcataagacgagaattcggactgaacgatctgttgggaaaaaaaggagaaaaaaatcgagacgaccaccgacatcacgctatagatgcatgcgttataggtgcactagaccgatcaatgttgagaaaattgcaaatagcaatggaggtagccgaaaaacaaaatagcgcacgcaattttgtcggcttacaagaaccatggtttaatttcagcacacaagtacgcaggtcaataggacaaatatatgtatcccataaaccgaaccataattatgaaggagagatttttgaagcatcaatatacggactaaggctcatatccgataagagaacagaaaagtacgtaggaataaaacgaaatccagaaacaggaaaaactgataaacctaaaaaatccgtagtagttatatcagatcccaaaacacaaaacagatatggactacgccataaatttcactctgaaggactaccaaaaaaatactatggactctcatcaagttcagtattctgcctcgaaatttacagagacgaaaaaggaaactggcaagcttacactataccacggtatgaagcatacagaatcgtaaaaagacgaggcgtaaacgcattatatgacaataaaagatctaactttgagggacgaccgctagttatgcgtctaatgcgagatgattgcatagcattcgaaaaaaatggagtcaaagaagtatatagaatacagaaaataaatggcttaaaaaaaaacataacacttactagacacttcgatgcaaatgttgacgatagatacagaagaatgctaaaagcacaaaaggccgaaaaagcaggtgaagactttgatagtgaagatttatgcgatgacctagtattttcttcattcggcgcatcaagtttatattcaaataaagcacgaaaagtaacgatatctcccatgggcgtgctacgagacccagggttcaaaggctga

SEQ ID NO: 5055 - RNA, 3267 nt, synthetic construct
  misc_feature 1..3267: note = Cas9 variant
  source 1..3267: mol_type = other RNA
atgaagaaattggtattggggttagacataggtgtcgcaagcgtcggttggggaatcatagacgcagaaaatggagacgtactagacgccggcgtaagattattcagctcaagagacgccagtgaaaatgagtcacgcagaacctcaagaagacaatcaagaagactctcaagaagaaagaaacataggagagaacgcattaaacaactactattagcacacgacatggacgtatgtgatatagtaaatgaaaatccataccaacttagagtaaaaggactaaacgaaaaactagaaatatcggaaatttacgtcgcactaacacaccttgctaaaaggcggggagtgtcatatctagacgacgtcgtcgaagaagggggagccataaaaagtgaacacttaaacaaaaatatggaagaaataaaatcaggaaaaatgccctgcgaaatacaattagaaagattcgaaaaatacggtcaagtaagaggtatgatagaaatcaaccaagacacagaagaatcttcattcctagtaaacattttcagaacatccgactatataaaagaagcgaaaacaatcttagcaacacaacaaaaatttcacaaacaaattacaaatgagttcatagacgaatatataaatataatggcatccaagagagactactttataggaccaggaaacgaaaaatcaagaaccgactacggcgtttacagaacaaacggcgatacatgggacaatttattcgaaattttaataggaaaatgtagcgtgtttccagaagaaacaagagcagcaagaagcagttacgtagcacaagaatttaaccttctgaacgatcttaacaatttaaaaatttcatcactagaatcaggaaaattatcaacaagtcagaaacacgacatcgtggaaaaggtcaaaaatagcaagaaatttggcaccaaagatttgctaaaatacatagcaagtgtatgtgaatgtaaaatagaaaatatagacggatgccgaaaagacaaaaatagaaaacccatcatgcatacatttgaaaactataggaaagtacataatgccttaaacgaagcgggtgtagacctacgactttctgaagcagattacgacgagttaatgaaaatcatgacgctcaattctgaaacactagagataaagaaacaatgtaaagaaaaactaccacatttaacagaagattacctaaatgtatgtcttgtcttaaacaagaaaggagcattctcaggatggcacgctctatccctaaaagctatgaaattaatgatgccagaattatacggaacaagcaaaaatcagatgcagataatccatactatgcaactcggcaaagcatatatcaaacctttaaaccaacaaaaatatctaaatagtgaagcaattttggaggagatatataaccctatcgcagcaagaagcatcagacaaaccataaaagtgactaacgcgatactaaagaaatacggacctttagacagcgtaatcatagaaatgccacgtgactaccaaacctcagaagacgaaagaaaaatgatagagaaaatgcaaaaagaaaacgaaaaggaaaagaaagccgcactaaaaagagcaagagaagaatacccattcccagacgaggcttttagaaatcacaaagaactagccacgaaactacgactatggtaccaacaagatcaattctgtgtatactctggaaggaaaatttcagtagtagatctagttagaaatccaaatcaattcgaaatagaccatataatcccacaatcagtatccctagacgacagtctaaataataaagttctatgtttcagtgaagaaaaccaaaagaaaggacaacaaacccctttctactaccacaaaggaaaatcaggaaactggacttacgaacaatataaattattcgtcgaaaaactatttgacaaaaagaaaatatcgaataagaaacgagaactactattgtttgaagaagatataaacaaatgggatgtcagaagaggcttcatagcacgtaatctagttgatactagatatgcaagcagagtaatcctaaacagctaccagcaatatttcggaaaccacgaaatgggcacaaaagtaaaagtggtaagaggaaaattcacctcccaattacgaaagaaatggaaaatattcaaagacagaaacgagagtcactcccaccacgctatagatgcattaattgtcgcagcaacagcaaatctaagactttggaagaaaaataaactaggaatctccgacgaaggaaaagtatacgataaagaaactggcgaaatactgccatttgagaaattaacagcctccgagtacaatgaaatgatgaacaaagaaccatatctcaatttcaaaacaaaactacaaaatatagagacaaaagtaaaatatagctataaagtatcgaagaaagttaatagaaaaataagcaacgatactatatattcaacaagagaacgagacggcatagactatattgtaggtaaaattaaaaacatatacgacgtaaaaacctacaaagaccaattcctaaaacgatataagaaaaacaaagaacaattcctaatgtaccaacacgacccacaaacatttgcaatattagaaagtataatggccacttacccagacgcggagaatccatttttagcctacaagaaagaacacggagtaataagaaaatatgccaaaaacaaagcgggagcaccagtaacatccttaaaatttatagacggcgcattaggacagaaaatagatgtcacttataaaaacaaagcagcattacccaaaaacaagaaagtagtactacaatcaataaaaccatatcgcgccgacgtatactacgacgaaggaaacaaaagatatcacctaataggagtaaaatattctctattctcattttcaaaacaaggatatgtcataaaccccatagcttatcaaaaacttctagaaaaagaacaaattcatagcgaaatgaaattttgtttcagtctatatagagaagacataatagaatcaggagaagacccagactcactgacaagatatcggttttggagcaaaaatgaatcaggtaaaaataaaatagaagtaaaacctattgaaaaaccaaactttgaagacagaaaagtaatcacaataacaaagaaaatcaaaatactgaacaaatatcaaacagatgtattaggaaattctttcaaagcacaagaagaaaaagatccaagatcaatcgaatga

SEQ ID NO: 5056 - RNA, 3267 nt, synthetic construct
  misc_feature 1..3267: note = Cas9 variant
  source 1..3267: mol_type = other RNA
atgaactataagatgggattagatataggaattgcaagcgtcggttgggcagtaataaatctagatctaaaaagaatagaagacttaggcgtacgaatatttgacaaagccgaacaccctcaaaatggcgaaagcctcgctcttccaagaagaatagcaagatcagcaagacgcagactaagaagaagaaaacatcgactagaacgcatacgaagattactcgtatctgaaaacgttcttacaaaagaggaaatgaacttattatttaaacaaaaaaaacaaatagacgtgtggcagctgagagttgacgcactagaacgtaaactcaacaacgacgaattagcaagggtattactacatttagccaagagaagaggcttcaaaagtaatagaaaatccgaaaggaattccaaagaaagcagcgaattcctaaaaaatatcgaggaaaaccaatccattttagcccaatacagaagtgtaggcgaaatgatagtgaaagactcaaaattcgcctaccacaaacgaaataaactagactcatacagcaatatgatagcaagagatgatctagaaagggaaataaaactaatattcgaaaaacaacgagaattcaataatcccgtatgcaccgaacgattagaagaaaaatatttaaatatctggtcttcacaacgaccatttgcgagtaaagaggatatcgaaaaaaaagtaggattctgcactttcgaacctaaagaaaaaagggcaccgaaagccacttatacattccagtccttcattgtatgggagcatataaacaaattacgattggtatcaccagatgaaaccagagcattaacagaaatagaaagaaacctcctatacaaacaagcttttagtaaaaataagatgacatattacgacattaggaaactactaaacctatccgacgatatacattttaaaggtcttctttatgaccccaaaagttctctcaaacaaattgagaacataagatttctagaattagacagctaccacaagatccgaaaatgcatagagaacgtctacggaaaagatggaataagaatgttcaacgaaacagatattgatactttcggttacgcattaacaatctttaaggatgatgaagatatcgtcgcataccttcaaaatgaatatataacaaaaaatggaaaaagagtgagcaacctcgcaaacaaagtttatgacaaaagcctaatagatgaattactcaacctatccttcagcaaatttgctcatttaagtatgaaagccataagaaacatactaccatacatggagcaaggcgaaatatactccaaggcgtgtgaactagcaggttataacttcacaggtcccaaaaaaaaagagaaagcattactcctacctgttattcccaacatagccaatcctgttgttatgagagctctaacacaatcaagaaaagtagtcaacgcaatcataaaaaaatacggaagtccggtctcaatacacatagagctggcccgtgatctatcacacagcttcgacgaaagaaaaaaaattcaaaaagatcaaacagaaaaccgaaaaaaaaacgaaacagccataaaacaactaatagaatacgaactaaccaaaaaccctaccggactagatatagtaaaatttaaactatggagtgaacaacaaggcaggtgtatgtattccttaaaacccatcgaattagaacgactattagaaccaggctacgtagaggtagaccacatcctaccctactccagaagtctagatgactcttatgcgaacaaagtacttgtactaacaaaagaaaaccgagaaaaaggaaaccacacaccggttgaatatttaggactaggtagcgaaagatggaaaaaattcgaaaaatttgtgctagccaacaaacaattttcaaaaaaaaaaaaacaaaatttactaagattacgatacgaagaaacagaagaaaaagagtttaaggaacgaaacctaaacgataccagatacatatcaaaattctttgctaattttataaaagaacatttaaagttcgcagacggagacggaggacaaaaagtttacacaataaacggaaaaataaccgcccatctaagatctagatgggacttcaacaaaaatagagaggaatcagacctacatcatgccgtagatgcagtcatagtcgcatgcgcaacccaaggaatgataaaaaaaataacagaattttacaaagcaagagaacaaaataaagagagcgcaaaaaaaaaagaacccatattcccccaaccatggccgcacttcgccgacgaactaaaagccaggttatccaaattcccgcaggaaagtatagaagctttcgcactcggaaactacgataggaaaaagctcgaatcgctaagacctgtattcgtatctagaatgcccaaaagaagtgtcacaggtgccgctcaccaagaaaccttacgcagatgtgtaggaattgacgaacaatcgggaaaaatacaaaccgcagtaaaaaccaaactctccgatataaaactcgataaagacggacatttccctatgtatcaaaaagaatcagacccgcgaacatacgaagctatcagacaacgattactcgaacataataacgaccccaaaaaagcatttcaagagcctttatataaaccaaaaaaaaatggagaaccaggcccagtcatccgaacagtgaaaatcatagacacaaaaaataaagtagtacacttagatggcagcaaaacagtagcttacaactcaaatattgtcagaacagatgtcttcgaaaaagacgggaaatattactgtgttcctgtttacaccatggacataatgaaaggtaccctaccaaacaaggcaatagaggccaacaaaccatactctgaatggaaagaaatgactgaagaatatacatttcaattttcactatttccaaacgatttagtaagaatcgtactacctcgagagaaaactataaaaacatcaacaaacgaagaaataataataaaggacatattcgcttactataaaactatagattcagcaacaggtgggctagaactcataagccatgatagaaatttttcactcagaggagtcggatctaaaacattgaaaagattcgaaaaataccaagtcgacgtgttaggaaacatccataaagttaaaggagaaaagagagttggattagcagctccaacaaaccaaaaaaaaggaaaaactgttgactcattacaatcagtatcagactga

SEQ ID NO: 5057 - RNA, 3270 nt, synthetic construct
  misc_feature 1..3270: note = Cas9 variant
  source 1..3270: mol_type = other RNA
atgactgcctttaaaccaaaccccttaaattatatactaggattggacatcggaatagcaagcgtaggctgggcaatggtagaaatcgatgataaagaaaatccagtaagattaatagacctaggagtccgtgtgttcgaaagagccgaaatgcccaaaactggagatagtttagccgcagcgagaagattagcacgctcagtcagacgtctaacacgtaggagagcacatagactactacgagcaagacgattactaaaacacgaaggtgtcttaaaaccagaagatttcgatgaaaatggcctagtcaaaccattaccatatatcccaaaacaaccacgtaatacaccctggcaattgagggctgccgccttagacagaaaactcacaccgttagaatgggctgcagtactactacatctagtaaaacatagaggatacctatcacaaaggaaaaacgaaggggagactgatgataaagaactgggtgccctactaaaaggagtagcagacaatacccatgcgttacaagctggaaactttagaacaccagcggaattagcactcaataaattcgaaaaagaaagtggtcacataagaaatcaaagaggtgattattcccacacattttcaaggaaagacttacaagcagagctagtactattattcgaaaaacagaaagaatttggaaatccttacgtatcagatgatttgaaaaacggaatagaaaatctcctaatgacccagaggccagcattatcaggagatgctattcagaaaatgctaggtcactgcacctttgaaccggccgaaccaaaagctgctaaaaatacttataccgcagaaagattcatctggttaacaaaattgaacaacttacgtattttaaaccaaggaaatgaaagacccttaacagatgccgaaagaacaacacttatggatgaaccctataagaaatcaaaattaacgtatgctcaagcaagaaaattactagatttagatgatacagcgtttttcaaaggattacgatatggtaaagataacgccgagtctgcaactttaatggaaatgaaagcataccatgccatttctagagcactagaaaaagaaggtttgaaagataagaaatccccgctatcgttaagtccagaattacaagatgaaattggaacagctttctcattatttaaaaccgacgaagaaattacaggcagattaaagggatgtctacagcccgaaatattagacgcacttctgaagcatattagtttcgataaattcgtgcaaataagtctcaaagctctaagaaggatagttcctcttatggaacagggaaaacgatacgacgaagcatgcgcggaaatctacggtgaccaccatggaagaagaaatagtgaagaaacactttatctaccaccgataccagcagacgaaatccgaaatccagttgttcttagagcattaagtcaagcaagaaaagtaatcaacggcgtaggaagaagatatggtagtccagcaaggattcatatagaaacagcgagagaagtagggaagagtttcaaggacagaaaagaaatagaaaagagacaagaagaaaatagaaaagacagagaaaaagcagcagcagagttccaagaatacttcccaaactttgtaggagaacctaaaagtaaagacatactaaaacttagactttacagacaacaaaattgtaaatgtctctactcaggcaaagaaataaacttaggcagactaaacgaaaaaggttacgttgaaatagatcatgctctccccttctcacgaacatgggacgactcgttcaataataaagtgcttgtattaggtagcgaaaatcaaaacaaaggaaatagaacaccgtatgaatacctaaatggaaaagacaattcaagagaatggcaagagttcaaggcaagagttgaaacaagtcgtttccctcatagtaagaaacaaagaatactattacaaaaattcgacgaagaaggttttaaagagagaaacttaaatgatactagatatgtaaatagatttttatgcaaatttgtagcggaccatatgcaattaactggcaaaggtaaacgtagagtatttgcttcaaacggacagatcactaatttactaagaggattttgggggctaagaaaggtaagagctgaaaatgacaggcatcacgctttggacgctgtcgtagttgcatgcagtacagtagcaatgcagcagagaatcacacgttttgttagatataaagaaatgaacgcatttgacggtaaaacagttgataaagaaacaggagaagtcctacatcagaaaacccattttccccaaccttgggaatttttcgcacaagaagtcatgataagagtatttggaaaaccagacgggaaacccgagctagaagaggctgatacgccagaaaagctaagagcattattagcagaaaagttatcatcacgtcctgaagcagtacatgaatacgtcgctccactattcgtaagcagggccccaaacagaaaaatgagtggccaaggacatatggaaacaataaaatccccgaaacgacttgacgaaggaataagcgtagtcagagtaccacttactcaactaaaactcaaagacttagagaaaatggttaacagagaaagggaaccaaagttgtatgaagcattaaaagcacgtttggaagcacacaaagatgacccagctaaggcgtttgcagaaccattctacaaacaagacaaagctggaaacagaacccaacaagttaaagccgtaagaatagaacaagtgcaaaagacaggggtatgggtaagaaaccaaaatgggatagccgataatgcaacaatggtccgcgtagatgtatttgaaaagggaggcaaatactacctggtaccaatatattcatggcaagtagcaaaaggaattttgccagataaagcaattatagcatttaaagacgaagaagaatggcaattaatagacgattcatttaattttaaattcccccttcatcctaatgatcttgtagaagtaataactaagaaagcgagaatatttggatattttgccagttgtcataggggtacgggaaatataaacataagaatacacgacttagataacaaagtaggcaaaaatggaatcctggaaggaataggagtaaaaacagcgttatcattccaaaaatatcaaatagatgaactcggaaaagaaatccgaccatgtaggttaaagaaaagacctcctgtacgatga

SEQ ID NO: 5058 - RNA, 3270 nt, synthetic construct
  misc_feature 1..3270: note = Cas9 variant
  source 1..3270: mol_type = other RNA
atgaacgtaagatataaaattggattagacataggtataacatcagtaggatgggcagtagtaaacctagacatacctcgaatagaagatctaggagtcagaatatttgaccgcgcagaaaacccacaaacaggtgaatccctagctttaccaaggagactagcacgtagtgcacgcagaagattaagaagaaggaaacacagactagagcgcataaggcgcctcttaataagagaaggcatattgatgaaagaagagttggacaagctctttgaagaaaggcatgaaatcgatgtttggcaattaagagtcgaggctttagatcgaaaattaaactctgatgaattagcacgtgttttactccatctagctaaacgcagaggatttaaatctaatagaaaatcagaacataacagtcgagaaaatagcacaatgctaaaacacattgaagaaaatagagccatcctatcctcatatagaacagttgcggaaatgatagtaaaagaccctaaattcgcattacacaaacgtaacaagggagaacactatactaatacaatcgccagagacgatttagaacgagaaatacaattaatttttacaaaacaaagagagttcggtaatatgaactgcacaaaagaatttgaaaatgaatatatcgctatatgggcatctcaaagacccttcgcttcaaaggacgatatagaaaagaaagtaggattctgcacttttgaaccaaaagagaaaagagcccccaaagcaacctatacatttcagtccttcatagcatgggaacacataaacaaattacggctagtatcccccgcagggacaagaggattgacagacgaagaaagaagactattatatgaacaagcatttcagaaaaataaaataacatatcacgacattaggacattattgcgactaccagatgatacatatttcaaaggggtcgtgtacgacaggaacatgccactgaaacaaaatgaaacaataagatttctagaactagatgcctaccaccaaataagaaaagttatagataaagcatacggaaaaggtaaatcgtcttcctttttacctatagatttcgatacattcggctacgcactcacactctttaaagacgacgccgacgtccgcagttacctacaaaacgaatacgaacaaaatggaaaaccaatgccaaacctcgccaataaaacctacgataacgaactcattgaagaactcttaaacctaagttttactaaattcggacatctaagtctgaaagcgctgcataatatcctaccgtacatggagcaaggagaagtatacagctcagcatgcgaaagggctggatataaatttacaggaccaagaaagaaacagaaaacaatgttactaccaaatatccctagtatagcgaatccagtggtcatgagagcactaacacaagccaggaaagtcgtgaatgccataatcaaaaagtatggatcacctgtaagcatacatatagagctcgctagagacctatcacaaacattcgacgaacgaagaaaaactaaaagggaacaagacgaaaatcggaaaaagaatgaaactgccataagacaactaatggagtatggattaacactaaatccaaccggacacgatattgtaaagtttaaattatggagtgaacaaaacggcagatgcgcatacagtctacaaccaatagaaatcgaaagactcttagaaccagggtatacagaagttgaccacgtaattccatacagtagatcattggatgacagctatacaaataaggtcctagtattaaccaaagaaaaccgtgaaaaaggaaatagaacaccagcagagtacttaggagtaggcacagaaagatggcaccaattcgaaacatttgtattaaccaacaaacaattctccaaaaagaaaagagatagattattacgactgcattacgatgaaaacgaagaaactgagttcaaaaacagaaatctaaacgacaccagatacattagtagatttttcgccaatttcataagagaacatttaaaatttgcagaatcagatgacaaacaaaaagtttacaccgtaaacggacgaataactgcacatttacgaagcagatgggagttcaacaaaaatagagaagaatccgacctccatcatgcagtagacgccgcaatagttgcgtgcacaacaccaagcgatatagcaaaaattactgccttctatcaacgaagggaacaaaataaagaactagcaaagaaaacagaaccacactttccccaaccttggccacattttgcagatgaactacgagcgagactatccaaacatccaaaagaaagtattaaagcactaaacttaggaaactatgacaatgaaaaactagaatcattacaccctgtctttgtttccagaatgccaaaaagaagtgtaacaggagctgcccaccaggaaacactaaggagatatgtaggcatagatgaaagatccggaaaaattcagacagttgtcaaaacaaaactatccgaaataaaactagacgccagtggccacttccccatgtacggcaaagaaagtgatccgcgaacatacgaagcaataagacaacgattactagaacacaacaacgatccaaagaaagcattccaggaaccactttataaaccaaagaaaaatggagaacctggccctataatccgaactgtaaaaatcatagacactaaaaatcaagtagtaccgttgaatgacggcaaaacagtagcatataacagcaacatcgtaagagtcgatgtattcgaaaaagacggtaaatactattgcgtccccgtatatacaatggatataatgaaaggtgtattgccaaacaaagcaatagaaccaaacaaaccatattcagaatggaaagaaatgaccgaagattatactttccaatttagcttataccccaacgatctaatacgaatagaattacctagggagaaagctataagaacaagtacgggagaagaaataaaaatcaaagacttcttcgcttattacaaaaccatccacagcggaacaggaggaatggaactaatttcacacgaccgatctttttctctcagcggagtaggctcaagaactttaaaaaggtttgaaaaataccaagtagatgtacttggaaatatatataaagtccgtggtgaaaaacgtgtaggacttgccagtagcgcacatagcaaaacaggtaaaactgtaaggccgcttcaaagcaccagagattga

SEQ ID NO: 5059 - RNA, 3273 nt, synthetic construct
  misc_feature 1..3273: note = Cas9 variant
  source 1..3273: mol_type = other RNA
atgagatggagattagggctagacatgggtgcaggttccctaggttggtgtgcagttggtctagacgaccaaggttaccctgactcaattttagcagcaggaagccatatttttggagacggtagagcaccctcaaggggtgatcagcaagggacaccactaggcgtagaaagacgagcagcaaaagcgatgagacgacgacgagacagattcttagggagacaagcaaagctgttagctagattaacactcgcaggtttatttccagccgatcccgtaagggcaaaagcactagaattacttgatccctatgttctaagagccagagcattagatgaagcattacccccgcaccagctcgggagagcattcttccatcttaatcaaagaagaggatttaaatcaaatagaaaaacggacagaggagttgacgacgaagcaggaaaaattgccataggaatagatagactaagagcagccatagcggcagcagaagctagaactatgggggagttcttgcataaacgacgacaatcagcaccggatgttaatcagatacctagtgttagaaccaggcttagaccagaaacaggagaggaggctaaaggagacggctacgatttctatccaggaagagaattagtagaagaagagttcgacgcaatatgggacgcccaagcgccacaccacccaagtctgttgacaccggacaatagggcgttacttcatgaagcaatattctatcaaagaccacttaaagctccaaaaataggaaaatgcacattactaaacaacgaaccaagactaccaaaggctcacccactctttcaaagaagaagacttttggaagaagttaacgcactcagaattgtaaggcccggtgaagtggctacaaagctaacctgcgaacagagagacttattgatgttgaaattaaaagacaaagctaaagtcagcttcgaaacactaagatcaaaagtactaaaattagaaccagaagcaagattcaataaagaaggtgaaaacagaacagaacttgtaggtgatgaagtatgtgcacaaatgtccgcgaaaacaagattcggaaaagcatgggctcattttaccgatgaaaaacgatgggcaattttatcaagactaattgaagaagaagacgaggaaagattagatacttggttaagaacagaacatggtcttgacgctgaacaagcaagagcagttgcgggtgccaggcttccggctgggtttggcaggtttggtgaaacagcaaccagaagactaatagcagctctacaagcagaagttatcgtgtatagtgaagcagttgtagcagcaggactaggacatcacagcgacatgcgcactggtgaagttttagcagaacttccctattatggtatgacactagaaaggcatttattaccgggaacaggagataaagccgatccagaagaactccgaattggacgactcacaaatccaaccgtacacatagcattaaataggcttagacgtatcgttaacaggttaataaaaacttacggacgaccagaacaaatcgcaatagaactgggcagagaactaaagctaacagatgaggacaagcagagattaagtcgacaaaacaacagaaacagagcagatgcagaagcaagaagtaaaaagttggcggaattaggacaagcagacaatggtgcaaatagggcaagactcaagttatgggaagagttaaacagagaaaatgctttggatagacgatgtatttatagtggtcagcaaatatctatcgcaatgttattctcagatgcagttgaagttgatcacatactgccatttgatgcaacgttagatgatagcaacaataatcgtattctttgtttaagagaatggaatcgaagaaaaagaaaacaaagtccttatgaagcatggggccacaccgattattggccagatatagcagcacgagctgccagactaccaaaagaaaagagatggcgctttgaaccagacgctatgcaaagattcagcgcagaagatagattcatagcaagacatttagtagacacacaatatatgagccgtttagccagagaatatcttgaagcattataccctgaaaaaggagaaggctccggtcacgtatgggtttcaccaggaagactgacagaattaattcgtagaaagttaggactaaacgaattattaccagatcacaattttgctggtgtcaaaaatagattagaccacaggcaccatacaatagatgcattcgtagtagccgtaacagatagatcacttcttcagggaatttctcgagcgagtgccttggaaggagaggaaggaagagagagagtaatagtacctgagccatgggacggttttcgagaagccctcagaacaactctaaatacaatcacagtatggcacagacaagaccacgggacagcatctaaagcaggattagctcaagggagagaccaaacagcaggaaaattacataatgatacagcatatggacttactgggagacaagacaccaagggtaatgatttagtagtgagcagaaagccattaatgagcttaaagccagcagatatagaaccagtccctgatgtcgcacctattactaaaggagttagagatagagatctaagaaaagcgctagctcactttacacaggcaactgaaggcaaaggattcctacaagcgctagaaagattcacacgacttggtccgcttcatttcagaggtattcgacgagtgcgattgatccaaccattagctgtaatacctataaaaggtccaggtggggtcccttataaaggatacctaggaggggaaaattttcgatgtgacgtatgggaaatgccagacggcgcatggaaacctgaagtgacatcgatgtttcaagcacatcagccaggctggacatcagcaattagagcagcatgtcctacagccaggaaagtgctttcactgcacaaaagagatatgatagcaatagaacgagaagaaggtgtgagaacgttgatggtagtcgcgcaaatttggtccaatggccaagtaacactcgttgaaccccacgaggccggcgacttaaacaagaggaataaatctgaagatgatccatttggatattttatgccaacagctggaggcctaaaaagattaaaagcaagacaagtcagagtagatgaactcggacgtgtccaagatccaggttttccagcaaggaaagcccgtagaaggaccagaccaaaacaggtggattga

SEQ ID NO: 5060 - RNA, 3273 nt, synthetic construct
  misc_feature 1..3273: note = Cas9 variant
  source 1..3273: mol_type = other RNA
atggattggagacttggcctagatttaggtgcaaattcgctgggatgggcagcattgcggttagacagggcaggagatccaattggcatactagctatgggttctcgtatcttctcagatggacgagacccaaaatccggagcttctttagctgtagataggcgagcagccagagcaatgagaagacgaagggacaggttcaaacagaggcaggccgcactactaaaatacttaatcagagacggcctctttccagcagaccaagccgacagacaaagattagcagatgaagatccatatgcattaagagccagagccctagatgaagaactatctttattcgaaataggtagagctctatttcacctgaatcaaagaagaggattccagagcaacagaaaggcagacagaggccaagatgatgaagccggaaaaatagccgtgggagtagacagactaaaccaacagatggaagaacagggcgcaagaacattgggggaatttttacatcaaagaagaagggcagcaacagatgccaaccatataccatctgtacgtactagattaagaccagaaacaggggaaggggcaaagggagacggatatgatttttacccatcgagagcactaatagccgaggaatttgaagaaatatgggctgcacaagcaccacactatccagatacactaacgcaacaagtacatgacagattatatgaaattatattccatcagagacccctaagagcaccacaagtcggacagtgtacgcttgttgccggagaaacaaggctaccaaaggctcacccactattccagaaaagacgattattagaggaaatcaatgctctaatgatagtaaggcccggtgagatagctcaacgattaactcctgaagaaagggatacgttgtacctcaaacttaaagataaacgaacagttagttttgcgacattgcgaaagaccttgaaactagactctgcagctagatttaataaagaaagtgaaaacagaactgaattaaaaggagatgaagtagctgcagaactaggagcaaaaacaaggctaggaactagatggcaacacctgagcggggatcaacaatgggaagttgtacacagactaatggcactagaaagtcaagcggatgaagcagcatttagagattggatttcccaaacatacgacctattaccagaacaagcagctgcagtattaggggcaagattaccacaaggacatggtagatttggaccaacagcgacaacaaccctgatagactcattattacacgacagaactgaagatgggcgggtggtagtgtatagcgaggctgtccaacgaagcggattaggtcatcatagcgatctacgtcacgatagagatgacgaagatgtaaccgaattaccatactatggagtagctttagaaagacatataatgccgggaactgcagaaccaacagatcctgaagaaatgagaattggtcgactaaccaacccaactgtacatatcggcttgaatcaactgagacatgtggtaaatagattaattagagcctatggaccaccaaaagaaatagcaatagaattagcaagagagctaaaactcagcgaggacgaaaagaagaaaagaaatagcgaaaatagagataatagactggctgcggaaggaagaagcaagaaattagaagaaataagacaaagagatacgggcgcaaatcgagcattattaaaattatgggaagagttaaatcctgggaatgttttagaccgaaggtgtatatatacaggcgaacaaataagcatcgatatgctattttcagatagagtagaagttgatcatatcctgccattcgcccagacactcgacgattcaaatggaaataaacttctatgtttaagggaagcgaacagagagaaaagaagaaggtcaccgtatgaggcttggggacatacagatagatggccagacattgctgaaagagcttctcgattacccaaacctaaaagatggagatttgaaccagacgctatgcaacgatttgcaactgaagacggctttctagcacgccatctagtagacacacaatatttaggaagattggcaagagaatatctatcatggttgtatccaggaagaggagaaggtagtgggcatgtgtgggtaagccctggaaggcttactgaaatggtaagaagaaaacttggacttaatgacttactaccagaccacaattttggaggaggagctgaccagcctaaaaaccgattagaccatagacatcatgcaatcgatgcgctagtagtcgcaatagtagatcgagggatgctacaagccatagcaagagcatcaggccaagatgggtcagaaggaagagaaaggattcacatcccagccccatgggatggttttagggatgatcttagagttgccgtcaatggaataatagttagccacagaccagatcacggtactgtagctaaagcgggtctagcacgaggtagggatcaaacagctggcaggctacataatgatacagcgtatggtttaacaggagaaacagatgcaaaaggaaacagcattgtggtgcgacggataccattgagcgctataaagaaacccgcagatatagccagagtaagagatccactcttaagaaatgctttagctgaatttactaaaggactagatggaaaagcatttgaagctcgaattggaagattccacgaactaggcccactactttatagaggaatcagaagggtacgagtcgtagaaacactaaccgtaatccctatacgggatgcagaaggtagggcatataaaggttataagggcgactccaactataggtacgatgtatgggaaatgccagatggaaaatggagatgtcaagtcgtatcaatgtttgatgcacatcagagcactgaacaagctcgaccacatccagcagctcgaaaaatacttagtttacaaagaaacgacatacttgcaattgaaagaactgaaggcgatagggaattagtgcgcgtagttaagttctcggaaaaacaatttgctgtcgctcctccacatgaaggtggatccttaaaaacacgagacggaaacgcagatgatccttttagatatttatacccgtcaccaaatacactcaaaggatggagggcaaggcaagttagaatagatgaactgggccgtgtactagacccaggtttcccagcacgcaagtctgtaagaagaactagacctagggcagctcctgtagattga

SEQ ID NO: 5061 - RNA, 3276 nt, synthetic construct
  misc_feature 1..3276: note = Cas9 variant
  source 1..3276: mol_type = other RNA
atgtactctaacttactattttcattcgacataggaacaaactcaataggatggtgtgttttcgcattagatgaagcaggagaaccttatagaatagtggacctcggagcaagaatatacgcagatggaagagacccacaatccaagacaagtctagcagttgcaagaagagaagccagagcaatgagcagaagaagagacaggtatctaagaagacgaaaggcaacattacgcacaatgatagaatacggccttatgccaggagacaaagccggccaagaagcagtattacgcgaaaccggagatagagaaggaggagatgaaagttttaatccatatgctctaagagcaagagcacttagcgaaaaactaccaccggcatatataggaagagtgctatttcatctaggacaaagacgaggctttaaatcaaatagaaaaactgatagaaaagacaatgataaaggtaaaatagcattgggaatagacgaattaaccgcagcaatgcatagatcaggaagtccaacactaggagcttggctagcaatgagacgtgccgaaggacatagcgtacgattaagagctggttccgaagtatttgatgcagaaggatatgctttttatccagagagaagcctcctagaagatgaatttagacaaatctgggacgctcaagcagtccaccatcccgacatcttaaccccagaaagacgagcgcatcttttcagagtaatgttttaccaacgaccgttaaagaaaccattagtaggacgatgtagttttaacccagctgagttcagattgagtcgtgcacatcccctattccaagaatttcggctatataaagagataaatgatctagaagtcgtcctaccagaccaatcacacagaaaattaacattagatgaaaggaacgctcttgttgcaaaattgaaaacttcaagaaaagcaagttttagtgctctaagaaaaacgttaaaacttaccccagacttagtattcaacaaagaatcagaagcaagaaaagaattattgggtgatgaaatttacagtgtactggcagacgcaaaaatgttcggtgcacgttggggtggttttagtagagctcgtcaatgggaaatcataacaagattaaaagaagaagaagaccctgcaagtctaagttcatggttaaaatccgagttcggcctagatgacgaaagagtaacagcaatagcaaacgcgagcttacctgatggttatggacgattgggagaaacagcactcgcaagtatgctggaagaactaaagacagcagtaataccggaatcagaagcagcgagactatgtggatacgatcacagcaacttagctaaagaacaagatgaaggactcgatacccttcccgagtaccaggagattttagaacgacacatacctccaggtactggagatcccgatgatatctacgatttaagaaaaggacggatcaccaaccccacagtacatataggactgaaccaactaagaagagtagtaaatgctctaattcatcgctttggacgtccgcaaagaatagtagtagaattggcaagagacctacaactatccgaaaaacaaaaagatgacgttaatagaaggatagcgaaaaacacaagagaagcagaaggacgatctcaaaaacttatagagatgggacaattagacacaggctataacagacttcttctaaaattatgggaagaattaaatttagacaaaccagaagaccgagtgtgtatctacagcggaaaaccaattggaatagcaatgctatttagcggagaagttgatgtcgaccatatattaccgtggagcaaaacactagatgactcacaggctaataaacttttatgtttaaaatctgcaaatagacaaaagcgaaatagaacaccatcggatgtcccagaatggagagatagatatgacgaagtgcttgcacgcgcagctagactaccaagaaataagagatggagattcgcggccgatgcaatgcaacaatttgaagcggaaggaggatttttggcacgacaactaacagatacccaatatttaagtaggatggcattagaatatttgagcgcattatatcccagtgaagaagcggataaaagtggagaattaagacaaagaaaaagggtccatgtagtaccaggaaggctaactgaactactgagacgtaattggggacttaacacattactacccgaccataatctaggtgaaatggcacaagagaaaaatagaagggaccacagacatcacgctatcgatgcagcagttataggaactacgagtcggtctttactgcaaagaatgagtggggcagcagcacggttggacgatgtagcattcgatgacttagttcggactgtggtaaaagataatcccccgtggccgggatttagggaagagttacttgctgctataggtcgcgttacagtatcccataaacccgatcatggaactgtaagtagagcagcatatgcacaaggtaaaggacagacggccggtaaactacacaacgatactgcatatggactaacaggattggtcgatgcgaaaggaagccccctggtggtcaggagaaaaccattcatggctctagaagtaaaagacattgctagtatacgcgatacggaactccaaagcgctttatacggtgcaataggtagtttaacagaaaagaaagctctacaagaggcactaataagatttagggatacacatccgcaatttaaaggaataagaagagttagagttctcgaaacattatctgtaataccaatagtagacagggacggcaaggcatataaaggatataaaggagacgcaaactaccgctatgaggtatgggaaactctagatgggaaatggcatactgaagtagtttctatgtttgatgcacatcaaccaggttggcaaagtccatttcataaacagaatcctgcagcaagacgtgtcctaaaattacaacaaaacgacatggtcgcatatgaacatccagctgatgggtacacaatagctagagttgttaaattcagcaacgataaaagaatttacttcgcatctcatagagaaagtggatcattaaaagcaagagatgcagataaaggagatccattctcttattttgctaaagcaaacaatggtctaagagatattaaatgtagacaagtcagaatagatgcggccggaagaatttttgatccaggacctcaagatcgggagacgcgacaagcaaataaaggtgtttga

SEQ ID NO: 5062 - RNA, 3279 nt, synthetic construct
  misc_feature 1..3279: note = Cas9 variant
  source 1..3279: mol_type = other RNA
atggcatacacaatgggcatagatgtgggaatagcatcttgtggttgggcaatagttgatctagaaagacagagaataatagatataggtgtaaggacgttcgaaaaagcagaaaacccaaaaaacggagaagctctagcagtacctagaagagaagccagatcatcaagacggagattaagacgtaaaaaacatagaatcgaaagactaaaatacatgtttgtccggaacgggctagctgttgatatacaacacctagaacaaactctacgcagccagaacgaaattgacgtatggcaattgagagtggatggacttgacagaatgctaacacaaaaggaatggctccgagttttgatacatttagctcaaagaagaggatttcaatcaaacagaaaaacggacggaagctctgaggacggacaagtgttggttaacgtcaccgagaacgacagactaatggaggaaaaagattatagaacagtagccgaaatgatggtcaaagatgaaaaattcagcgaccataaaagaaacaaaaacggcaactaccacggtgtcgtttctagagcctcattattagtagaaatacatacattattcgaatcacaaaggcaacatcacaactttttagcaagcaaagatttcgagcttgaatatattaatatatggagctcacaaaggccagtagcaacaaaagaccaaatagaaaaaatgataggcacatgcacatttttaccaaaagagaaaagagctccaaaagcatcatggcattttcaatactttatgctactacaaactattaaccacatcagaataactaatgcccagggaaccagaccattaaataaagaggaaatagagcaagttgttaatatggcactcacaaaaagtaaagtaagttaccatgatataagaaaagtcttagatctatcagaagaatatcaattcgtgggactggactacggaaaagaggacgaaaaaaaaaaagtagaaagcaaagaaactataattaagcttgatgactaccacaaattaaacaaaatatttaacgaagtagagctcgcaaaaggcgaaacatgggaagcagttgattacgacactgtagcatacgcactaacattcttcaaagacgatgaagacattagggattacttgcaaaataaatataaagactctaaaaatagattagtgaaaaatgtagcaaacaaagaatacacaaatgaattaatagaaaaagtctcaacacttagcttcagaaaagtaggccacctttcactaaaagctttaagaaaaataataccattcctcgaacaagggatgacctatgataaagcgtgtcaagccgctggatttaattttcaaggaataagtaaaaaaaaaagatcagtcgtactcccggtaattgaccaaataagtaacccagtagtaaacagagcactaactcagactagaaaagtaataaatgcattaataaaaaaatacggaagcccggagacaatacacatagagaccgctagagaattatcaaaacgattcgatgaacgaaaaaatataacaaaagattacaaagaaaatagggataaaaacgaaagagcaaaaaagcacttatcagaattaggtataatcaatccgaccggcttagatatagtaaaatataaattatggtgtgaacaacaagggagatgtatgtacagcaaccaaccaatatcattcgaaaggttgagagaaagcggctatacagaagtagatcatataataccatactcaagaagcatgaacgactcctacaataatagggttttagttatgacccgggaaaacagagagaaatccaatcaaaccccttacgaatacatgggaaatgacactcaaagatgggatgaattcgagcaaagggtgacgacaaatccacaaataaaaaaagaaaaaagacaaaacttgctactaaaaggatttacaaatagaagagaactcgaaatgttggaacgaaacttaaacgacacaagacatataacgaaatacttaagtcactttatatccactaacttagagttctccccctctgataagaaaaaaaaagtagtaaacacaagcggaagaataaccagccatctacgatcgaggtggggactagaaaaaaatagggaacaaaatgacttacaccacgctatggatgccgttgttatagcagtaacttcagactcttttatacaacaagtaacgaattactataaacgaaaagaaagaagagaactaaacggcgatgataaattccccttaccttggaaatttttccgcgaagaagtcatagcgaggttatcgccaaaccctaaagaacagatagaagcacttcccaaccacttctacagtgaagacgaactagcagatctacaacccatctttgttagcagaatgccgaaacgtagtattacaggcgaggcacaccaagcacaattccgaagagtagtaggaaaaacaaaagaaggaaaaaatatcacagcaaaaaaaactgcactggttgacatcagctacgacaaaaacggagattttaatatgtatggaagagaaacagatccggcaacatacgaggccattaaggagagatacctagagtttggaggaaatgctaaaaaagcattcagcacagatctccacaaacctaagaaggacggaacaaagggtccgttaattaaatcagtgagaataatggaaaacaaaacactagtccacccagttaacaaaggaaaaggcgtagtttacaacagcagtatcgtaagaactgatgtatttcaaaggaaagaaaaatactacttattacctgtctatgttactgatgtaacaaaaggaaaacttcccaacaaagttatcgcagctaaaaaaggatatgatgattggattgaagtggacgatagctttacattcttgtactcgttatatccaaatgacctaatcttcataaggcaaaatccaaaaaaaaagatttcgttaaaaaagcgaatagaaagccattcaattagcgattcaaaggaagtgcaagaaatattaacatattacaaaggtgtagacagctcaacggctgccatcgagtttataacccatgacggatcatattacgcaaagggggtaggtgtacaaaatttagactgctttgaaaaatatcaagttgacatattgggaaactactccaaagttaaaggagaaaaaagattagaattagaaacaagtgacaataaccataaaggaaaagacgtaaacagcattaaatctacaagtcgctga

SEQ ID NO: 5063 - RNA, 3279 nt, synthetic construct
  misc_feature 1..3279: note = Cas9 variant
  source 1..3279: mol_type = other RNA
atgaaatacagcataggcctggatattggcatagcaagtgtaggctggagtgtaatcaacaaagacaaggagagaatagaagacatgggtgtcagaatatttcaaaaagcagaaaatccaaaagatggatcatcactagcttcatcaagaagagaaaaacgaggatcacgccgtagaaacagacgcaaaaaacatcgactcgatagaataaaaaacatcttatgcgaaagcggacttgtcaaaaaaaatgaaatagaaaaaatatacaaaaatgcctatcttaaatctccatgggaattaagagctaaatccttagaagccaagatatcaaacaaagaaattgcacagatattactacacatcgcaaaaagaaggggattcaaaagcttcagaaaaacagaccgaaatgcggatgatacgggaaaattgctatcgggaatacaagaaaacaaaaaaattatggaagaaaaaggatatttaacgattggcgacatggttgccaaggaccccaaatttaatacgcacgtaagaaacaaagcaggatcctatttattttcattttccaggaaattactagaagacgaagtcagaaaaatacaagcaaaacaaaaagaattagggaacacacacttcaccgatgacgttctagaaaaatacatagaagtattcaattcacaaaggaatttcgatgaaggaccaagcaaacctagcccatattacagcgaaattggacaaattgctaaaatgataggaaattgtacattcgaatcatcagaaaaaaggacagcaaaaaacacatggtcgggcgaacgcttcgtattcttgcagaaactaaacaattttagaatagtaggcttatcaggaaaacgaccattaactgaagaagaaagagatatagtagagaaagaagtctacctcaaaaaagaagtcagatatgaaaaactaagaaagattttatatctgaaggaagaagaaagattcggggacctaaactacagcaaagatgaaaagcaagacaaaaaaacagaaaaaactaaattcatatcattaataggtaactacacaatcaaaaaactaaacttatcagaaaaactcaaaagcgaaattgaagaagataagagcaaactcgacaaaataattgaaatattaacgtttaataaatccgacaagactatagaatcaaatctaaaaaaactagaactaagtagagaagatatagaaatcctactatccgaagagttcagtggtacactgaatttatctttaaaagcaataaaaaaaatcctcccttatttagaaaaaggactatcatataatgaagcatgtgaaaaagctgactatgactacaagaacaatggtatcaagttcaaaagaggagaattactaccagtagtagacaaggatctgatagcaaaccccgtggtattacgagcaatttcacaaacacgaaaagtagtcaacgcaatcataagaaaatacggaacaccacacacaatacatgtagaagtagcacgagacttagcgaaatcgtatgacgacagacaaaccattatcaaagaaaacaaaaaaagagaactagaaaatgaaaaaacaaaaaaattcatatcagaagaattcggaatcaaaaatgtaaaaggaaaattattactaaaataccgactttaccaagaacaggaaggaagatgcgcatactcacgaaaggaactatcactatccgaagtaatactagacgaaagtatgaccgacatagatcatataatcccgtactcaagaagcatggatgactcttacagcaacaaagtattggtactcagtggagaaaacagaaaaaaatctaacttgttaccaaaagaatacttcgatagacaaggaagagattgggatacatttgtattgaatgtaaaagcaatgaagatacatccgaggaaaaagagcaatctactgaaagaaaaatttacaagagaagacaacaaggattggaaaagtagggcactaaatgacacacgatacatatcccgctttgtcgctaactatctcgaaaacgcactagaatatagagacgatagtccgaaaaaacgagtcttcatgattcctggtcaacttacagcacaactgagagcaagatggagattgaataaagtgagagaaaacggcgatttacatcacgcattagatgccgctgtagtagcagtgacagatcaaaaagcaataaataatataagcaacatctcacgatataaggaattaaagaactgtaaagatgtaatcccatccatagaatatcacgcagacgaagaaactggagaagtatatttcgaagaagttaaagacacaaggttcccaatgccatggtcaggattcgatctagaattacaaaaaaggctcgaatcagaaaatccaagagaagaattttacaatcttttaagtgacaaacgatacctaggatggtttaactacgaagagggctttatcgagaaattacgacctgtattcgtaagccggatgcccaatagaggagtcaaaggccaagcccaccaagaaactataagaagttcaaaaaaaatatccaatcaaattgctgtaagcaagaaaccactcaatagtataaaacttaaagatctggagaaaatgcaaggacgagatacagacagaaaattgtatgaagcattaaaaaacagactagaagagtacgacgataagccagagaaagcatttgcggaaccattctacaagcccacaaacagcgggaaacgaggacctttagttaggggtataaaagtcgaagaaaaacagaacgtcggagtctatgtaaatggaggacaagcaagcaatggatcaatggtacgaatcgatgtattcaggaaaaacggcaaattctacaccgtacccatatacgtacatcaaacacttctaaaggaactaccaaatagagccataaacggcaaaccgtacaaagattgggacttaatagacggttcattcgaatttttatatagcttttatccaaacgacctcattgaaatagaattcggaaagtcaaaatcgataaaaaacgacaacaaactaacaaaaacagaaataccagaagtcaacttatcagaggtattaggatattatagaggcatggacacaagcacaggagcagctacaattgatactcaagatggcaaaatccaaatgagaatcggtatcaaaacggtaaagaacataaaaaaataccaggtagacgtactcgggaatgtatacaaagttaaaagagaaaagcggcagactttctga

SEQ ID NO: 5064 - RNA, 3285 nt, synthetic construct
  misc_feature 1..3285: note = Cas9 variant
  source 1..3285: mol_type = other RNA
atgaaatcaacattggctatagcatctatttcaagtctaggatgggtaatcgaattaggagaaaatagaataatgagactcggactagatattgggtcaaccagtatagggtggtggatctacgagacaaccgacggacaaataacaagtgtaatagatggaggtgtgagaattttctcagatggaagagatcccaaatcaaaaggtagcttagcagtagaccgaagagttgctagagcacaaagaagaaggagagaccgatatttgcggcgaaaagcagcattaatgaagaggatggcagaagtaggactgatgcctagcgacccaaaacaagcaaaacaattagaagcacttgacccttatgagttaagagcaagaggacttgacgagacccttgaattgacagaacttggacgcgcactatttcatttaaatcaaagaagaggatttaaatcaaacagaaaaaccgacgcaggagataacgaatcgggaaaaataattgatgcaacagctagactagattgggcaatgagagatcaccgggctcggacatatggtgaatttttacacatgcgacgtcaaaaagcagacacacctcgtacaactccagcagtaagaacaaggttaacaatagcagcaagagatggtgcagaaaaagaagagtcggggtacgatttctaccctgacaggcaacacctgagggatgagtttgatgcattatgggaagcacaagctgaatatcatggggttttaacagaagatttaagagatgaaataggaactattatatttcatcaaagaccgctaaaaactccaaaagttggcaaatgtctttttactaacgaagaacgtgtggcgagtgcccaccccttgaatcagagacgaattttagttgagactgtaaacgccctaagagtagcccaattaggagaagtagcacgagcccttacactagaggaaagagatactatattacatgcattggataacaaagcacacacaaaatcactaagcggaatgagcataaaattaaaagcgttagggaaagtaataaaattacgatcagggcaatatttcaccctagaaacagcgaacagagatgcaatagcatgtgatcctgtaagagcttctttaagcaaaccggacagaataggatcatattggagtacactcgatcataacgcccagtgggaagtggtaaaccgaataagggcagtgcaatctgatgcagatcacagagaattggtagcatggctagtatcccaacatagactcgccgcagagcatgctgaaggagcagcatatgcaccattacccgatggttattcaagattaggtataacagcaactaaaagaatacttgctgccttagaggcaaacgtcattccgtacagtaaagcagtagagagttgtggttggcaccattcagatgagagaaccggagaagttctagaccgcttaccgtattatggagagatactagacagacacgtaattccaggaacgtacgatgactcggacgacgatattacaagatttggaagaataaccaatcctacagtacatataggactgaatcagcttaggcgattagtcaatagaataatagaagtacatgggaaacccgacgaaatagttgtagaactagcgagagaccttaaactaagccaagaccaaaaagcagatgtcgaaagaactattaaaaagaatactcaagcagcgataagaagaggagaaaaactagaagagatgggagtaccaaatacaggaggaaatagaatggtattaaggttatgggaagacttaaacgatgacgatgtaatgaagagattttgtccatatacaggacagcgaataagtgcgggaatgttatttgatggatcatgtgatgttgatcacattctaccattttctagaactttggatgacgggttcacaaataaaaccctctgtctaaaagaagcaaatagaaagaaaagaaattacgcccctcatgaagcagcagagaaagggctcttagatagggatgcaatggattctgtagcaaaatatctacccgacaataaggcgtggagatttgcgccggatgcaatagaacgatttgaaggcgaaagggacttcacagctagagcactaaaagacacacaatatctcagccgattagcaagaacctatttagacgccttatatgatggaggagatgataaaagtcatgtttgggtagtacctggtcgattaaccgaaatgcttagaagacattggggacttaatggacttgaagcattagcagatagtgacgagaaaacagtaaaacggaaaaatagaactgatcatagacatcatgctatagatgctgcagttgtagcggctacagatagatcattaatccagaaaatatctaagatagcagcatcagatgaacaagcaggagcagaagatacattgaagtcaactccaccaccatgggatagctttagggacgatatagcagcccaactacagaatataacagtgtcgcatagggcagaccacggcagaacagatagtctagcaaaagggcgtggagaagatacaacaagtggagcactacacgaagcaacagcattaggaataatcgatgaaacccatgtaacagtcagaataccaattgaatcgttaaaaagcggacacctcatcgaaggatctagaaatggatatataagagacccatacctaagagaccaattaacattagctactaaaaacggaagtgataaagatttcacaacagtcctacaaaaatttttcgatcgtagtaaaagatacggagggaccagaagagtacgcataattaaaacactgcaagacactgcccgcatatctgtaccacacaatgcaccaataaaagcctacaaaggaggcagtaaccatgctttcgaaatctggaggctgccaaacggaaaaattgaaagccaagtcattactacttgggaacatcacaatctaacagaaccgaaacgtccgcaccctgctgcaaaaagaatcatccgactacacaaaacagatatggtcgcaatagaaagggatggtaaaaccgttatatgttttgtgcagaaaacagatccaagtaacggggcgtttttggtaccacatttcgaagcgaacgcagacggaagaaaacggaaaaacgaacctgtagaatggtaccaaatgtcagcaaactccctaataaaagcagatttgagaagagtaggggtagatgaaatgggaagagtacgagatccaggaccaccacccattagatga

SEQ ID NO: 5065 - RNA, 3285 nt, synthetic construct
  misc_feature 1..3285: note = Cas9 variant
  source 1..3285: mol_type = other RNA
atgaaatacagagtgggctttgacctgggaactaacagcttaggatgggccgttgtacggctaaatgccagtggggaaccagatagaatagaagttgctggcagcagaatattttctgacggaagggaaccaaaaagtggtgcgagtttagcaggggcaagacgagatgcaagagcaatgaggaggcggagagataggtttaaacaaagacaagcggcattaataaaatatctcacacaagcaggattctttccagccgatgaatcagagagaaaagctctaagcgcactagatccatatgaactacgagcaagagcattagatgaagcattaccactagcgcatcttgggagagcattattccatttaaatcaaaggagaggattcaagagtaatagaaagacagatcgaggaaagaatgacgatactggtaaaataagaattggggtagcgcgactatacgagcaaatgagagatgctgacgcacgaacactcggagagttcttacataaaaggagagctgctgccagtgatccaaacgcaataccacatgtgaggactcgaatagttacactagcggcagaggatggtaaagcaagcgatgtatatgatttttatccagatagacaaactcttgaagaagaatttgaagctatatgggaagcacaaacgagtcaccatccggaagcgctgaccgaggagcgtagagcacaattctacgaaatcatatttcatcagagacctttaaagcaaccgaagataggattttgtacgcttctaccaccagagaaaagattaccaaaggcccacccattatttcaaagaagaagactactagaagaagttaacgcattgagaatagtcttgccagggaaagaaacaagagcactagaaaaagcagaaagagatgcattattaagcaaacttaatcaaagaaagaaagcagcgtatgaaagtctaagaaaagcattaaaattagacccagatgctaggttcaataaagaaagcgacaacagagaagacatgataggggacgaaatagcagctgaaatggcacataaatccagattcgggaaagtgtggctaggaatgagtgcggaagcacaggcccaagttatagaaagattaagaggtttagaatccgatgcagatgcagatgactttgaagcatggctacgggatgatcatgggctagcgcaagaacaagcgaaggcagtaacagcggccaatttaccagaaggctacggaagatttggggaaacagcaacgaggaaactaattgcagctttggaacaagaagtaatagtatattcagaagctgtgcaaagggcaggtctcggtcaccactcagacttacgggatggccaagtgtggacagacaagaaaggaaatccagccctcccctattatggtgcagtattagaaagacatatagtacctggaactgcagatcctaacgaaacagacgacgcattaagaataggcagactaacaaaccccacagtacacataggattaaatcaacttagaagagttgtaaatgcattaatgagaaggtacggacaaccgcaggaaatcgcaattgaattagcaagagaactaaaactatcagacgataggaagaaagaaataaatacgaggaatagagaaaatcgaaaagcagcagagaaaagatctcagaaattacgaaatataggacaagcggataaaggaggtaatagggccttactaaaactatgggaggaactcaatccagaaaatgtattagatagacgatgtgtatacacagggagagtaataagtatcgatatgctattcagtggagcggcggaagtagaccacatacttccttttagtgtatctctagatgatagtaacggcaacagaatattatgcctaagagaagtaaatagaataaaacgacaaagaactccatgggaagcacgagatgacctacgagcacactttggcccagatgcaggttgggaagcgatagccgcaagagcagctcggctgcctagggagaaaagatggagatttgaaccagacgcagcaaatagatttgatgcacaaggtgggttccttgcacgccatctgaccgatacacaacatttgagtagactggcaagaagctacttaagtgcactctaccccgaaactggagaaggctcaggacatgtttgggtttctccaggaaggcttacggaaatgcttaggagagcctggtcattaaaccatcatctgccagaccacaatatagcaggagcagcaaatcagcctaaaaacagaaaagatcacagacatcatgcaatagatgcgatcgttgtggcattggccgatagagcaatgttaaatagaatagccagagaatcaggcaaagaaggacatgaagcggcgggccggttagttgcgagtattcctgaaccgtgggaaggctttagtgatgaagtagggagagcagtacgagctataactgttagccatagaccggatcacgggaccgctagtaaagcaggcagagctaaagacaaagatgcaacagcaggaagattacataacgaaacagcatacggattgacaggagaaaaagatgccagaggactagatatagtagttacacgaaaaccattaagtgctttcaagaaaagtgctgacttagacgcaatcagagatgatgatttaaaacaaaaactgaaagcctgggcagcaggtaaagaaggcggagcattcgaacaagctatgcgtagtttcggagatccagagagaggacctagaagtcacccaggactaagaaggataagggttactgaaccattatccgtaatcccaattagagatcgcgatggaaggccttataaagcatataaaggggactcaaattatagatttgatatatgggaattgaaaacaggtaaatggaaagacgaagtggtaagtatgtttgaggcacatagaccaaattggacaagtccaatcagagccgggaacccaacggctagaaaagtattaagcgtaagacaaaacgatgtaattgcaatagagcgagaaaatggcccagaactcatgagggtggttaaatttagtgcaggatcactagccctagcacccccacaggaagccggatcattaaaagcccgagacgctgacaagaatgatccctttaaatatgtgtacggcagccctagcagtttacaaagatggaaagctagacaagtaagaatagatgaactaggacgtgtgttcgatcctgggtttgcagtacgaagtagacgatcaagtgaatga

SEQ ID NO: 5066 - RNA, 3291 nt, synthetic construct
  misc_feature 1..3291: note = Cas9 variant
  source 1..3291: mol_type = other RNA
atgaaaaatatattttcattcgacataggaacaaattcaataggttgggctgtattagcacttgatggaaatggagacccagtaagaatcgccgacgcaggagtaagaatattctccgatggacgagatccaaaaagcaaagcatctttggcagaagcacgaagaatggcaagagcaatgagtcgaagaagagatcgaacattgagacgcaaacgggccactttaagaactttagcagagatagggttaatgccggacacgagctccgcaaggcaggcacaattaagagagacatcggatccaaaaagtgggagtggacaattgacacgaaacccatatgcattacgagcattggcgttagaagagaaactaccactatttcatataggtagagcgttgtaccatttaggacaacggagaggatttcaatctaataggaaaacagatagaaaagacaacgataaaggaaaaattgcactcggaatagaagaactacacgccgcaatgaggcaggatggtgcccaaacatacggacaatggctcgctcgaagacacgcactaggtcaagccgtcagactcaggagcggagcgttagaccttgaaggagaaggatatgctttttaccctgaaaggaaactactagaagatgagtttcatcgaatatgggaggctcaagcaagacattatccagatatattaacaccagaaagaagagaccatctatttacagttatgttctttcaaaggcctctaaagaaacctaaagtaggaaaatgtagttttaataaccaagaagaaaggttatcaaaggcacacccgctatttcaggaatttagattatataaagaagtaaacgaactagaaatagtcgaaccagatctaactcacaaaaagctaacactagaccaaagaaatgcattagtaaagaaattacaagtaagtagagaggcatcgtttgccgccctcaggaaagtgttaaaacttagaccagaccaacgactaaataaagaatcagaaagcagaaccaaattaaaaggaaatgaagtgtatgcagtactatcggataagaccagattcggaccgagatggggaacattttcccaagcagaacaatgggctataatagaacgactaaaagaagaagaagatcctggacgcctatttgcatggttaagatctgctttcggtattgaaggagaacaagctgctgatatagccaatgtacatttacctgaaggccatggacgattaggaaaaacagcccttgaagccatgctagaagaactcaaggcggaggtaataacagaagctgaagcagcaaaacgttgtggatacgaccatgctagactagggggagggagtgatgaaggagagccagaacttccaccctaccaagaaatacttcaacatcgaataccacccggtacgaataatcctgacgatccatatgacattgaaaaaggaagatttacaaatccaacagtacatatagcacttaatcaattacgtcatgtaatgaatacactcataagaagatacggaaaacctgcacaaattgcagttgaattagcgcgagatttaaaattaagcgaaagacaaaaggaagaagtgaacagaacaatagcaagaaacaccagagatgcagaaagacgcggaaaaacgctagaagagaatagaataccaaacacaggatataatcgcacattattaagactatgggaggaactaaacccaggaaaagtagaagacagatgttgtatttatacaggtaaacctatatcaataagcatgctattctccggagaagtagacatagatcatatattgccatggtcacgcactttagatgacagccatggaaacaaactattgtgtctaagagaagcgaacagggtaaagagaaacagagctcctgcagatgtaaccgaatggagagacaactacgacgaaattctcagcagagcagcaagattaccgcaaaataagagagacaggtttgccccagacgcaatggaaaggtttgaaaaggccggaggttttctagcaagacaattgaccgatacacaatacttaagtaggatggctttagagtacctagcttgtttattcccggctgaggaaatggatggatttggagaactaagaagacatagatatattaacgtctgtccagggcgattaactgaaatgcttagacgaaactggggattaaattccatcttatcagatagtcaattaggtgaaacagcgcaagagaaaaaccgaaaagatcatcgtcatcacgcaatcgatgcaatagttattggagtaactggacgatctttactaaatagaataagttacgctgcaggacgcctagaagcacaacaattggaaacactcgtaaaagaagcagcggctacaaataaaccctgggacggttttagggaagacgtagcaaaagtagtgggcgggatcattgtatcacacaaaccagatcatgggacagcaggcagaaaagcaaaagatcctgcaagacaacaaacagcaggaaggttacataatgatacggcatatggattgacaggagaaacagacgcaagaggcaatacaatagttgtacggagaaaaccgtttttatccctgacgtcaaaggacataccgagcattagggacgaagcccttagggcagtcttagaacaacatctacgaggcataccagatggaaaagcatttcaagccgcattagacgcctttagaaaacaaaaaggatttcaccactaccatggaatacgacatgttcgtttgactgaacccctaagtgtgattggtataaaagatagagatggcaaagtttataaaggatataagggagatgctaatcaacgttacgatgtctgggaaactttagacggtaaatggcacgccgaagtagtaagcatgttcgatgcgcatcaacctggatggcaatcaagattccatgctgaaaaccctactgcaagaagagtattaagattgcaacaagatgatatggtagcactaaatgctcctgacggtggacgcctcttagtacgagtagtaaagttccgacaaaacgggcagattactttcgcaggtcacaacgaatctggaaacttgaaagctagagatgcggcaagtaacgaacaagatccttttaaatatattagtcgaatggcatcatctttgaaggattgcggatgtcgtcaagtcagaattgatgctacaggacaagtatttgatccgggtccacaagatagagcatcaagactacagaaacaaagtaaacgatga

SEQ ID NO: 5067 - RNA, 3294 nt, synthetic construct
  misc_feature 1..3294: note = Cas9 variant
  source 1..3294: mol_type = other RNA
atgaagaaacaacctcaaaggtacatattaggacttgatcttggaatagcatccgttggatgggcactaatattagttgacggagccgaaaatccagtcggactattagattgcggtgtaagaacatttgaacgcgcagaagtacccaaaactggcgattcattggcgttagcacgaagacaagcaagaagcgtaaggaggttaatcagaagacgagcacatcgactactaaggctaaggcgtttactcaaaagggaaggaatcctttcagcagcagacttcaattcagacgggcttccaaatctacctatagacgcatggcaactaagagttgcaggactggaaagaaaattaacaaatcaagaatgggccgcagtattactacatttagttaaacatagagggtacttatcacaaaggaaaagtgaaacgcaaacagagaataaagaattgggacgtctattagccggtgtagctgaaaattcgaaactattaagtgaatctagcgaacaataccgcacgccagcagagctagccgtaaaattattcgccgaacaatcaggacatttacgaaataaaggaggagaatatactcatacatttaatagattggatctacaaaaagaactacatttactatttgaaagacaatacgcattaggcaatccattcgcttctgcagagttacaatcaaaagtcgatgaattattaatgacacaaagatcagcactacaaggcgaagccgtactcaaaatgttaggaaaatgtacctttgagccttctgaatataaagcggctaaaaatacatacagtgcagaaagattcatatggcttacaaaattaaataaccttagaatattatacaacggtgaagaaagagccttggatgaaggagacagaaagaaactcctcgacgagccatataagaaagcaaaattaacatacaaacaagtaaggagcatactaaatctgcccgaatccgcagtatttaaaggacttcgatacggaaaagattcggacggactaaaagctgagaatggaacactaatggagatgaaagcctatcataaaatcagaaccatcttggacaaagcaggactaaaaggagaatgggaaaatagaattagaaatcccgaaatattagacaaaatcggcacagctttctcactatataaaacggacgaagatatacaagcagcgctagccgatttaagattgccagaaaatgtactagacgcccttttagcaggactgaactttgataaatttatacaattatctttgaaagcgctacggaatatacttcctttaatggaaagaggaattagatatgatgaagcatgtaaagaggtttacggtgaccacagagctcttgcagaatctaaaaaccaggtattattaccgcctattcccgcggacgaaatcaggaatccagtcgttcttagaaccctaacacaagctagaaaagtaataaacgcaataatacgaagatacggatcaccccagagagttcacattgaaacagctagagagttaggaaagagtaaacaagaaagagacaaaatagaccgcaaaaacaaagaaaatcagaatgacagaaatagacttgcatcagatatcagaaaacattttaattttgaacccacccctaaggacatactaaaattgagactatacgaacagcaacatggaaaatgtttatactcggatttaagagaagaaaaaggagaatgtctatacacaggaaatgtcatagaacttcacagacttttcgaagatggatacgttgaaatagaccatgcattaccattgagtagaacatgggacaattctctaaataacaaagttctagtactaaaatcatccaatcaaaacaaaggtaataaaactccatacgaatggctcgatggcgcaaacaatagtagaagatggagagagttccaagcaagagtacaaggttgccatttcccatatgtaaagaaacaacgcattcaaacagctaaacttgacagtaaagcagaacagggtttcctcgaaagaaacctcaacgacaccagatatataagcaaatttatgtgtcaatttataactgcaaacctacgattagcagaaacaagcaatgctctaatggaagaagtagcaggagaaaatccctattggaaagaacgaaaaagacaacgagtattcgctccgtcaggttccataatagcacttctaaggggactctggggcctaaagaaagtaagagaagacaatgatcgacatcatgccttagatgcaattgtagtagcgtgcagtactgtaagcatgcaacagaaaataactaaagcaatgcaacgacgcgaaaccttagaaacagtagactcagagaccggagaagtaaaaacacgaataccccaaccatgggatttcttcagacaagaggtgatgatacgagtatttagcgattctccacgcgaagaactagcagaaaaactcaattcaagacctgaagcattacatgattttgtcagccctttatttgtaagccgtgctcccaatagaaaaatgacaggtcaaggccatttagagaccgtgaaatcagcaaaaagattaagtgaaaacatatctgtcgtacgaaaacccctgactgcattaaaactaaaagatatcgaaaatatagtagggtatcccgacagagaacctgcattatatcaagccttaagagagcgccttctcgcacataaagatgatcccgttaaggctttcgcagataaaccattctataaaccagcgaaagatggtggccaagggagccttgtaaaagctgtaagaataattgaaaacacaaaacacggactaaaaattagaaacggcatcactgacacaaacggagatatggtaagaacagacgtgtaccagaaaacagataagaaaggtaaaagacaatactttatagtgcccgtctacgcatggcaagtagagaaaaacgaactaccaactgtagactgcaaagggtacgaaatagacgacaactacgaattttgcttttcattatataaatatgacctgatagaaatacaaaatcccaatgatataaaccaagaactgagagcttattatataaactgcgattcctcagacgggagattttggctagcctatcacgacaaaagcgctaaagaacaacaatttcgaataagtacacaaaaccagccaataataaagaaatatcaagttgacacactagggaaagaaataagactatgtaaagcagagaaaagaacagccctaaacggtaaaaagaagaaatga

SEQ ID NO: 5068 - RNA, 3294 nt, synthetic construct
  misc_feature 1..3294: note = Cas9 variant
  source 1..3294: mol_type = other RNA
atgggaaagggtgacatcttattcagttttgatataggtacaaactcaataggatggtgtgtgtttgcactctcagataatggagacccatgcagaatcctagatgcaaacgctagaatatttgcagatggaagagaaccgaaaagtggaaattcactagcggaaggtcgcagagcagccagagcaatggcaagaagacgagacaggtacaaacgaagaagaaaagcagtacttaggacgttaactgaatacggactaatgccagcagatcccaaagctagacaggctttagtagctaaaactggagatagaggaccgaaaagtgaagaagcactagcagatgtatactccctaagggcaagagcattaatggaaaaactacccttacaccatataggaagggcattatttcatttaaatcaacgtagaggctttaaaagcaacagaaagacagataggaaaagcaatgagaaaggggcgattgagactggagtaaatcgacttttagaagaaatgcgagacacaggtgcacccacattaggggcttatttagctaaacgaaggtcagatggacgaccggtccgagtcagagccggcgcttcagagcaagaggccgaagatggaaaacccgcgaaaaccgcatacgatttttatccagttcgcagattattagaggaagaatttgacgctatttgggaaaaacaatactcatatcacccagaagtcctaacagaagaaagaaggggtcatttattccgggtaatgtttcatcaacgacctctaaaaccagcaatagtaggacgctgttcatttaatagtgcagaaacaagattagcaaaagctcatccgttattccaagagttcagattgtataaagaagtcaatgaattggaagttgtaatgcccgatcaatcgcacaggaaactaacgctacccgaaagagatcgtctcgtattaaaactccgtggacagcgaaaagcgacatacgcggctctaagaaaagaactacgactacgtgacttgcgatttaataaagaaacagagaataggactgatatgatgggtgatgaagtaacagctgcattagcagacaaagccgtattcggaaatcgatggtcaggattttcaacagacgaaaaatggagaatagtagaaagactaagggaggaagaagacccttttgctttacacgaatggctcgttagtgaacacggcttaagtgacgccgaagcagaacaagcagcaaaagtgcatctaccggacggatatggaagattaggtcctactgcagtgtcgactatgttagaggaattaaaagctgacgttataacggaagcagacgcagcaagattagctggatacgatcactcacttgctagagcagacgaagatgggttagatagactccctaagtaccaagaggttcttgaaagacgaatacctccgggaaccaatgacccggatgatccatacgacatcgccaaaggtaggataacaaatccaacagtgcatatagctctaaaccaattcagacatgtagtaaatgccttagctcgacgattcggtaaaccagatcaaatcgccatagaactagcaagagaattaaagttaaatgacaggcaaaaagacgaagtaaatcgtgttataggaagaaacacacgcgctgctgccttacgttcacaaaaactaagagatattggtcagaaagataatggatataatagagctctacttaaattatgggaagaacttaacccagacaaaccagaagacagagtctgcgtatacacaggaaggccaatttgcataagcatgttattttcaggcgaagtagacgtagatcatattttgccatggagcagaactatggatgattcacaggcaaacagaatcttatgcgtagttgaagcaaacagggtaaaggcaaatagagcacccgcagaagtagcagaatggggaggaaggtatgacgaaattttagaaagagcggcaaggttaccgagaaataaaagatggcggttcgctagagacgccatggaaaaatataaggaaaatgaaggattcttggcgcgacaattaacagacacacaatatcttagcagattagcgagagaatatgcggaggctttatacccaacagaagaacctgatagattgggggaattaagacgtcgaaaccacgtaagagtaattcctggtagactaacagagatgctacggagaggttggggtttaaatgctctattgcccgatcataatttcggagcaggacaagccaaaaacagaaaagaccatcgacatcatgcaatagacgctgcagtagtcggagtaacaacacgaggtctattacagaggataagtacggaagctggattaagagaaaaattagcacttgaagagacaatagcggatatcccaatgccgtggccaggatttagagaggaactgaaagccgccatagaccgggctgtagtcagccataaaccagaccacgggacgttgccgaaacctggtgaacatgggagaacagcaggtcaattacacaacgacacggcatacggaataacaggagaaacagacgcaaggggaaacccaatagtagtaagaagaaaaccatttctttcattgacggacaaagatatacctagtataagggacacagaattaagaggaagagtatactcagcaacaagcggactatctggaagagaactatccgcagccctagattattttcgaaaaaccgacaaacaattccgggggataagacacgtacgtgtaacagaaagtctttccgtaataccgataagagatagagatggaaatatatacaaagggtacaagggtgacgcaaactttcgatatgatgtttgggagttaccagatggcaagtggaaagccgatgtagttactatgtttgatgcccatcggccagacagagccgcagaagaacgacgtccacacccagcagccagaaaagtattgagtctaaaacaaaatgacatggtagcttgtgaacacccaaaagatggatacacaattggccgagttgttaaatttaacactgcaggacaaatatactttgccgcccacaatgaaggtggaagtctaaaagcaagggacgcagatcgagcagacccatttaaatatttctcaaagagtgctagtggcttaaaagaaatagcagcaagacaagtaagaatcgatgcaactggacaggtactagaccctggcccacaagatagagaatcaagattagcgagaaacaagagacttgaaagagaaagagcatga

SEQ ID NO: 5069 - RNA, 3303 nt, synthetic construct
  misc_feature 1..3303: note = Cas9 variant
  source 1..3303: mol_type = other RNA
atgaagtatacaataggactagacatcgggacaagcagtgtaggttggggcgtaatagataccgaaaggaaccgaatccaagatctaggagtaagattattcgaaagtgcagaaaaccaaaaagatggagaatcactagcaaaaccaagaagggacgcaagaagcatgaggaggagactagctcgacgagggagtcgtctcgaaagagtaaagagcatattcgaaaaagccaaatttcttactagaggacaaatggggataacacacgctcgcccaaatgatccctacagattacgagcggaaggcttagatcgtcttctatcaaacgaagatctattcatcgcagtataccatctcgcaaaaagaagaggttacaaatccaacagaaagaacgtactagaaggagatggagaagatgtacgcgaaggaaaagccgttttggatggagtagcacaaaataaaaaactgatggcattccgaggctacagaacagtaggagaaatgttttttaaggatagtgttttcacagaagcgaaaagaaacaaagcaggaagttacaaacactgcgtactaagagaaatgttagaagatgaactgggaaaaatactgcatgctcaaaggagtctcggaaacaccttagttacagattcattcatctctaagcttctcgaaaaaaaaacaggagtgttcgtataccagagaccttttgcatcaggtaatcaaatactcaaactcgttggaccatgcacattcgaaccagaagaaatacgagcagcaaaggcaacatactcttttcaatactttaacgtcctacaacgtttaaacaatctaacaataaaaaacacagacacaggaacagaaaggaaattgaccagtgaagaaagagcaaaaatgatagccttcattttctcacataaagatgtgcaatacgcacagataagactcgaactcaaactaagtgatgttgataggttcaatatggttaattatttcgttcaaagaaaagaactagaaacaaagacagcagaagaactaagaagggaaatcgaaaaaaaaaccaaatttccaagtttatcggactactacacaattcgaaagacagtaagcgagatagattcagcgttttggatccaaatagaaaaacaacacgatgtcatagacgcgataggggaaatattcacattgtacaaaacagatgaagacataatagcacaactaaacacaagaatcccttccatacccagaccagtagtatcagctttacttggactaagctttacaaaatttggccaccttagtttaaaagctctaagaaaaattataccacatttagaaaacggagacacatatgacgtagcttgcgctaaagctgacccaaaatacacagatcgagcaaaaacaagagcaagaaagctaagacccctagataaagaagaccattcaataacaaacccagtagccagaagagctatagcacaaacgatcaaagtagtaaatgccataatagacaaatacgattctccgagtgaagtacacatcgaattaggacgggatttagcaaaaaatttcaaagagagaatgaagatacaaaaagaacaaaaacaaaatcaagaaggcaacgaaagagctattgcaaaaatacatgagttgtataaattagaaaacccacgaggacaagacataataaaattccgattatggaacgaacaaaacggacaatgcatgtattcaggcgaaagaatagatgaaattagactattcgacaacggttacactgaaatagatcatataatccccttttcgagaagttttaacgatagctactcaaacaaggtacttgtattaaaaatgagaaatcaagaaaaaatgaacaaaacgccatacgaatatatggggggagacgcagacacctggcaaaggttcgaaaacttagtgaactcaatgcataatataggaccaagaaaaaaacaaaacctcctcctaaaaaaatacgtcgcagacgatctcacactaagaacattaaatgacacacgatttatagctagatatatgaaaaattatattgaaaacaccttactttttacggaaggaccacaaaaacagagagtgtatacagtaaacggacaagccacagcctatctcagaaaacgttgggtacttcacaaagacagaacagaaaacaaccgtcaccacgcacaagacgcagtcgtggtagcagtagcaaccccaagtctagtacagggaataatgcgacatgcaaaaatgggagaaatagtggattacttacattcacaaaaatttgcacctaacgtaactgatatagaaactggcaaaccatttgaatccgcagacatccaatcagccaaagaaagaataatagcaaaacatgaacatcgattaagaatacccgagccttgggagggattctcagacgaactagacgcaaggatgggagacgatgtcgttgaaaaactgtcattaagaaaaagcaacattcatgggtacaaaacaacaagcgacttcagtcagatacacccaatttttgtaagcagaatgccaaaaagaaagacaactggaagagcccatcaagaaacattaagaagtcctaggaggttcaaagagtttcaagaaagtgttgtgcgtacccccctatcaagcattaatcttaagaaactagaagaaatgagtggaaaaaactcggacaaactactatacgacatactaagaaaaagattacttgcacatggagatgatcctaaaaaggcctttacagaaccagttcacaaaccaagaaaggacggaacccaaggccctttggtaagatcaataaagatggtaagcgaagggcaaagaagtgggattctagtaaataacgaacaagcattagttgaccaagacagcatgataagaatagatatatttagcaaacccaacaaaaaaggaaaagatgaatattacataattcccgtttacgcataccattttgcccaaaaagagttaccaaataaagtcataacagcgaaagcagaagcagactggagaaccatagacgacacgttcgcctttgaattctctctatatccaaacgacctggtaaaactaactaaaggagacgatatcagattcggctactattcaggatgtaatagggcactagcagctatacatatattgccccatgaccaaaacatgccgctcgttaataatggcattaaaaccttagataagatagacaaatatgtagtcgatatactcggggaatatcacaaagttggcaaagaaacgagacaacagatacaatga

SEQ ID NO: 5070 - RNA, 3303 nt, synthetic construct
  misc_feature 1..3303: note = Cas9 variant
  source 1..3303: mol_type = other RNA
atgggagcgacaatcgtgacggatataagtagatcagcatttgcttttgatataggcacaaaaagtataggaagtgcagtattaagacttgacgataggggagaaccgataggaataataaacgccgcggtaagaatatatgcagatggaagagaaccaaaaagcggcacaagtttagcagaaggacgaagattagcccgaggaatgagtcgtagaagagatcggtataaaaggaggaggaggactctattaaacaccctaacagagttcggattaatgccaccaacagacgaagctcgaaaagcactattagcagaaaccaacgatagaagatttggagccgtggcaggaaatgtatacgcactacgagctcgagcactagatgaaaaactccccctacatcatttaggaagggcgttatttcatctgaatcaaagaagaggattcaaaagcaatagaaaaacagataaaagagataatgaccagggaaaaatagcaagcggtatttcacgcttgggacaaaaactagatgaagctggagccagaactttaggagagttccttcatagacaacatagtgctggaaaatgggtaagagttaggccaagccgggttccgagtaaagatgataaagaggaagacggatatgggttttatccagaacgatcttttctagaacgagaatttgcagcaatatggaaagcacaagccgcattctacccagagctcctaacagaagaacgtggagaccatttgcaccgtgtaatgttctttcaaagacccctaaagagaccgaaggtaggaaaatgctcattttacccggatgaagacaggctacccaaagcacatccactgtttcaagagtttcgcttagtaaaagagttaaatgaactcgaagtagtacaccgaggtgacaggcgagaaaagttaacacttgaacagcgagacacactgtttaatcaactaagaacacaaaggtcttccgcgttcactgcactaagaaaaacattaaaagctccaacagggacaaggtttaataaagaatcggacgcaagagacaagttaaaaggagatgaagttgctgcagaaatgtctcataaagacagatttggtcaggcttggataggaatgccgcttgcagaacgatgggcagttatcgaaatgttattagatacagaggatccactagaggtaaaagcatggctagaagaacattacggctttgcagctgatagaatagatgcaattgcagccgctaaacttccaccaggatatggaagattaggtgaaacagctctaagggatatgttagatgaattaaagaatggaacagtcaaagatgactcaggaagggatgtagtattaacagaaagacaagcaatggacaatatatggaaggacaaccctgctttacaaagggtggtcgcagacgctcgtgaactgccaccgtaccaagaagttttaggtcgacgtattccgccagggactggaaaaccagaagacccttatgacgtgcaaaaaggcagattaaccaacccgaccgttcatataggattaaaccaattaaaaagagtagtaaatgcattagtaagaaggcatggacgtccagaccaaatagcactggaattagcaagagagttaaaactaaacgaagaacaaaaagccgaaaaagatagggaaatagcgaggaatacaaaagcggcacaggcacgaagtgaaaaattaagacaactagatatagacgataacggttacaatcgtgttctgttaaaattgtgggaggacttaaatttaagacagccagaaaacagagaatgtatatattgcggaaaggcaataggaataggtacattattctcaaatcaagtcgacattgatcatatcttaccatggtcaaaaacccttgacgattcacaagccaacagaatagtatgccatgtagaatgcaatagacaaaaaggaaatcacgcgccggctgaagtgccacaatggcacgatcgatacgatgacatactagctcgagctgaaagattacctagaaataaagcctggaggtttggccgagaagcgatgaagaagtttaaagatgatgaatcatttttggccaggcaactaactgacacacaatatttgtcccgaatggctcacgaatatgttgctgcactttacccagacgaggagcctgatgaatggggagtatttacgagacgaaaccacgtaagagtaataccaggaagaatgacagagatgttaagaaggcaatggggattaaatgccataatctcagaccatgaccagaaaaatagaaatgatcacagacatcacgctatagacgctatagtcgttggagttacaacaaggagactattacagagaatcgctactgcggcgggaggaagagaggcattagcgttggaggaaacaataggtaagatcgaacctccatggcccggattctatgacgatgtgaaagaagctatagacaggattgttgtcagccataaaccagaccatggttcattaccaaaacctggagaaccggcacgaactgctggccaattacataacgacacagcatacggatttacaggagaggaacgaaaaggtgtaccaatcatggtgcatagagtaccatttgccaccttaacagaaaaagatataccatcaataagggacaggcagttagcggaagcactgtacggggcaatagctgggataagtggaaaagctgaattggcagccgctctagcacgattttcagcaagcggaccttataaaggaataagacatgttagagtagtcgaacctgtctccgtaattgcaataaaagacagggatggaacaccatacaaaggttacaaaggagatgcaaactacagatacgacgtttgggaactaccgaatggaaaatggactcatgaagtagtatccatgtttgatgcccatagacccgactggcagtctgaaataagaaataaaaatccagctgcaagaaaagttctatcattacatcagaatgatatggtagcctacgaacaccctcaagacggttataccataggcagagtcgttaaatttggatctgggggacaaatggcattagcaggaaatagagaaggaggagctttgaaaagtagagatgctgatcctgaagacagatttagatacttttacaaatcaggaggagccatgagagacgcaagactgagacaagtcagagtagatgagacaggacgcgtttttgatccgggtcctcaagatagagaaagtagaaatgccaggaaacaatccgcagccgggtga

SEQ ID NO: 5071 - RNA, 3306 nt, synthetic construct
  misc_feature 1..3306: note = Cas9 variant
  source 1..3306: mol_type = other RNA
atgaaaaccttaggccttgatcttggtactaattcgttgggatgggcaattgtagaaacaagagacgaacccacaaaatattcagaaggatcaatagtagcttcaggagtaagaatattctcacaatcagaaatggcaggaagagatccccaatcgaaagcctcattagcagtagcaagaagacaggcaaggggatcccgaagacgaagggaccgttatctgaaaagacgacaacggctggtcgatttgcttgtagaccttggactaatgccagcagataaggcagcaagggcagaattagttaaaaatcacggagacggaaagacaggagatttgagttcaagcgtatatgcattaagagctcgagcccttgatgaagcattaagtccgtatgaaatagggagagcaattttccacttaaaccagcgaagaggatttaaaagtaatcgaaaagcagatagtaacgatccagaacaaggagtgatcagcgaaggaatgagggcattggatgagaaaatggcggaagctggcgcaagaacaatcggagaatggttacatatgaggagattacaaggcttacccgtaagggcaagaatagcaccagatggagaaggttacgctttttatccatcacgaggggcgttagaaagagaatttgaccgaataatggcacgacagacactatttcatactgacctgttaacagacactgccatacgagaattaagagaagtcgtatttcatcaaagacccttacgaccagtaaaaccgggaaaatgtagctacaatccattagaagaaaggctagcaaaagcacacccattattccaaaaatttaggcttctaaaagaactgaacgaattggaaatagttggtgaagatcaaaagcacatcaaattaacaccggaacaacgaaatgctttagcgttacaactacgaacttcattaacaaagcaaggaaaagtaccttttagtaaactgaggagcacactaaaattagggagagaagtaagatttaataaggaaacagacaacagatcagatttagaaggagatgtaatatatttcaggatgtctaggccagaatgtttcggaaaccgttgggcagatttaccagttgaaatgcaagcggcaattacagaaagattgcgaacagaaccagattataaaacactaatgaattggttaaaagccgaaacgggtctagatgaagtacacgcgagagctgtagctgatacaccagtgcctgacggtttcggaagattaggacaatctgcattaacagcattgatagatgcattggaaaatgaagtgggtgagggaggttttgtaattactgaggcagaagcagcaaaaagggtatacggacgtacgaacagtgaagccgatccagatagaaaaggcgttgatgaattacccaagtaccaagaagtcttggcaagacacattccccctggtaccggtgagccagatgatccgtacgatgattttatgggaagaataaccaatccaacagtgcatatagccttaaatcaactaaggagagtggtaaatgcacttataagaacatatggaaaacccgatagaatcgcaatagaggtagggagagaccttaaaatgaatgatagagaaagagacgaagttaatagacgtataggacgtaatacaaaggcagctattgaaagaggtgtaaaattgacagagacctttaggcaacttgatactggatataataggttaagattagaactttgggaagatctcaatcaaaagcctgaaaatagggtatgcatatattgcgggaaagcaatagcaggccacatgttgttcaatggagaaactgacatagatcatatattgccgtactcaaaaacactagatgattcgaaagccaacagaatactatgttgcacgagttgcaacagggaaaagaaaaatagaccacccagtagggtacctcaatggagaagcaggtatggggagattcttgcacgagcaactacactacccaaaaacaaacagtggagatttgcagaagatgcaatgacaaggttcggagaagaagagggatttctagcaagacagcttacggatatgcagtatatttctagactagcactaacatatctagcacatctatacgattatgaagaagttgatttggacggtatctataaaagacatgcaagggtcagagcattaccaggccgaatgacagagatgttacgcagacaatgggggttaaatgaacttttacacgatcataatcttataggtggtgatgtggctaaacccaaaaatagactagatcatcgccaccatgctatagatgccatcgtaattgcatgtacatcaagggcacttatccagcgattagcaactgcaagcgctgcagcagaagaaagaggagcagagagagtagttgaaaggatagatccaccttggtcaggttttagggaagatgttagggcagcagtgggggcaatagttgtgagccataaacctgaccacggaactgtgggcagagaggggtatgcaaaaggtcgcggacaaacagctggtaaattacataatgatacggcctacggccacactggggaaaaagacgcatcaggaaatgatattgtagtacgacgtatagccgtgactgatataagatccccggcggacataagaaaaataagaactaatgcacacggacattcagaattaagagacaggctatacgaagcaacaagagggctcgaaggcaaagcctttgaacaagccgttttagattttgttaaaggggatgcaaaatttaggggaattaggcatgtaagaattactgaagttgccaatccagtttggataacccacggagatggaagacataagaaaggatatttacccggtggtaatgacagattcgatgtatgggaacttgcagatggaagatgggatgcagaagttgtaacgacatttgacgctcatagaccgggatttgtcccaagaatgaggctagaaaatcacaatgctaggaaaatcatgtcattaaagaaaggggatatgatagcatacaacgatccagtatcgggacaacgaattatcgctatagtaagaaaattcgaccagcgaaataaacagttatatttagatccacataacgaagcaggtaacctggacagacgggaaaaagagaaaacgtataaaccacttcgacccatgcctaatcctttaaagaaatataggcccagacaagtgagaatagacgaaattggccaagttttcgatccaggcccatggtgggaaagacaagatggttga

SEQ ID NO: 5072 - RNA, 3306 nt, synthetic construct
  misc_feature 1..3306: note = Cas9 variant
  source 1..3306: mol_type = other RNA
atggaacaaacaagtctcgacttaagccaagctatgaagaaagtcgcgcaacctcaaaaaccctaccgtctcggtgtcgatgtaggagtcgcatccattggcgcagccgcagtaacagatacagaaatactaggaatacatgtcaggacatttgagaaaggtgaaataaatggcaaaagtggacgaaaacccttaaacgcagattatagaagacaaaaaggacaaagaaaacgactcaggagaaagaaaaaccgcctgctaagtttacgtaggctattcaggagagtaggaatgatagaaagcgcagcaattgaagcatttccaataagctcgacatctccttggcaattaagaacagaaggattagacagacggttaacgaacgaagagtgggcacaagtattgtaccacattgcgaaacacagaggattccagtcaaacagaagagtagacatggacgaagcaacaaaattaagcgatgccgcaggcgattctccagaaacaaccacaaatacggagagtgattcagacactaagaaaatgttagcaggagtagcagataacaaaagactccttgctgagaaaggataccgtacaataggagaagctgtcgctcgtgacccaaaatttagtcatagaatacgaaacaaagaagaatcatactcacatacaataggccgagatgagattaatgcggaactaaactgcctttttcaggcccaaaatcattacggcaacccacatgctacagaagaacttagcgaacaaattatagatttaatcaactggcgtagaaaaacagttaccggtgacgatataaaaaggatggtaggacgatgcacactagaaccaaaagaatatagagccgcaatacattctgtaagcgctgaagaatttagatggttatcaacattaagtagattaagaatcgtaactcaaggagaatcaagaccattaacaaaatgtgaatgggacaaagtagtagatctcccttggcggcaagaagcaatcacatatacatcaataaggaacgcaataggtttacgacacgatattagatcaagattcaatataagatacgaaaccggaggaaagaaaactaaaaccgatactaaaaatgaaacaacaaaaggacaatccgcagacgcagtaaccagtgaagttaaaaccgcagaaaaagaaacagcgttcaaagctaaaggatatcacatcttaagaaaagcatacaaagcctttggatatgatgagcaatgggaccgagacagattcaatactgaattgttagacacattagccacagcagtcacattctataaagatgatagcgaaatccaagcccacctcgaaacaaacgataccccagaatacgcaatacagattgctctacgactcccaacattgactaaatttagtaaattaagcaacaaagcaatcctaaaaatattaccacacatgagagaacgccaatcatactccaacgcttgcctactagcaggctacaaaaaccaccataaacaatacgatgatacaccacaaaatggaaaaataccaagatccgccatagaacatattaaaaatacagttgtatacaggagcttgaaccaagcccgtagggtaataaatgcaatggtaaaagaatatggagcaccccaagaagtccatatagagcttgccagagatatggagaaaagtgcgaaaaagaaagatgaaatagacctttggatgaagaaacgcaaaaagaaaaatgacgaattgagggagagattcggtaaaaacctatctagagacgaattattaaaatacaaactatacgaagaacaaaatggacaatgtgcatattcactccaaccgatacaattaggacgattacttgaaccgaattacgtcgaagtagaccatgcactacctagaagcagatcaatggataattcatataacaataaagtcctagtactaacaaaacaaaacagagataaaggagaccggacaccctttgaatacttcggagaagaccaagagtcagtagactggaaacgttttaccaattgggtagaatcaaatccgcaaatgccacaagcaaaaagaagaaaattactaacaaaatcactacaaaaaggtatattagacaatttctcagcgcgaaatctttccgatacgcgatatatagctagagaacttaaaactttgatcgaacattacattcttaatactccagaaagagagaaaaccaaatatgaacgttgtgtagttataagcggcaaattaaccgcacaaatgcgacaactatgggggatatccaaagcacgagatgtaagcgacagacaccacggcagcgatgcagcagtaatcgcatgtatcacaccatcaatggtaagacgaatcacaaggtacttacagctacaggaacgacgtgcaatgccaagcgcaccaggaaaaggagatgaacacccagcagtagttgcaagagcaattccacacgcaccagtaccatggccaacattcgaacacgatttagaagctgcactcgaaaaagtactcgtatcacgaccgcaatccagaaaatggagcggaccaatacacgcagataccatatatggagaacacaaagatcaagaaacaaataccgtcgctccaactcaacgaatcaaattaacacaactaaccaaaagtaactataaaaatatcgtcggatacgacgaagaacgaaacaaagacttcatagaccagatagaagaacgcctagaatgccataattttaacggaaaacaagcattcggaacaagccaatcccctatatatcgcattaagaaaaatggagaactaggcccagaagtgaagaaagtcactataaaactcccgatcaaaaactctgtctttaggataagacgtggatatgtcaaaaacgctaaaaattcaacgatatacataaatatctatcaaaatactaaaacaggaaaattcgaaatgcatccagtatacgcaaaagacttaacatctagtgcaaacgcaagcaaatcatttgaatactcaccagacctacagctagttgatacaataagacgaggagactacatagaaataaccagaagaaacggagaagtaatatcaggatactatgcaacacataacatatcaacatccgttctagaattacaaccacatgacactacagacagtaggaataaccgcacaccagcaatcaaaacatcactaaacatcgaacgatttcatattgatatattagggagaaaacgcagagtggtaaggagagcgaaaaatggcctagctgatgacagggacaaatga

SEQ ID NO: 5073 - RNA, 3309 nt, synthetic construct
  misc_feature 1..3309: note = Cas9 variant
  source 1..3309: mol_type = other RNA
atgggttataggatcggactagacataggcataacctccgttggatatgcaatactaaaaacagacgaaaaaggatcaccgtacaaaatcgaacatttaacttctgtaatcttcccaatagcagaaaatccaaaagacggaaagagccttgcaatgccaagaagagagcaaagaggcgcaagacgcagaaacagaaggacaaaattcagaaaacaccgaacgaaaatgttattcgtaaggtcggaattactaacgataaaacaaatagaagcaatttacagcgaaaaacaaaaactatcatccatatatgagttacgaacaaaagcactaaacgaaagactcactaatgaagaattatttcgaatactatatttcttttcaggtcaccggggatttaaatctaataggaaaagtgaactcacagaaaaagacatgggtccagtattaacagcaataaaagatatagaagaaaagttagcagatggaacatacagaactttgggagaatacatggaattagacgaaaaataccaagaacacaaaagaaacaaagacggtatagatcggtatctaggaactgccaaaagaagcctaattgaagatgaaattaaacaaattataatagcacaacaacaattcggaaacacgaaactaacaagtggattccaagtagcttttataggagacgaagaacaaaccggaatattcaacgatcagcgggaatttgaagatgggcctggtaaacaaagtccgtatgccggaaatcaaatagagaaaatgataggagcctgcacatttgaagaaaatgagaaaagagctccgaaagcatcatataccttccaatactttgacttcctctgcaaactaaataacctaaaatacagagaaacaatcggaggggaataccgattcctaagtcttgaacaaaagaacgtattgaaagaaaaggtgttgaccacacagaaaatcaccttttcaggtgtcaagaaattactcgacttaccagaacacgcacaatttaacctagtaaactacggaacgaaaagcacagtcaaagaaacagaaactaaatcagtattttatgctatgatatcttaccacaaattaaagaaagcaataccggcaccaatctttagtaacttaagcacagcagaattggacgaaataggcagaatacttacattatactcatcagacaaaggtcggaaaaatgagttctacagcagattagctataccagaagaagtagtagaagcattattaccaataaattttagtaaattcggaaacctaagcctgaaagccatgagaaaaattataccctatctggagatgggtctagtttactctgaagctgcaacacaagcaggatacgacttcagacataagaaaatagaccaggcttatatacacgaaaacgtaacaaatccggtcgtaaaacgggccgcctcacaaaccataaaaatagtaaataatataattaggaaatacggagaaccggacggaatcaacatagaattagcaagagaactaagcaaaaatttcagtgaacgcaagaaaacggttaaatatcaagaagaaaatcgtgcaagaaacgaaagaattgcagacaaattaagagaatgcgaattgcctgtcaacggagccaatatcacacgtctaaaattatttgaagaacaaggagaatttgatccatacaccggattaaaaataccctttgatcgagccttttctgaagaatacgaagtagatcacataataccttattctaaaacattagatgacagttacggaaataaaatacttgtttctgcaaaagcgaatcaagaaaaagggaacagaatccccatggaatacttacaaggaaaacctgaaagaataaagaaactagaaagtattaccgcgacaatcaaaaaccctaagaaacgagaaaaactactaaaacaacaattgaccaaggaggatgtagacggctggaaaactaggaatttaaatgacacaaggtatataagcagcttactacatgactattttaaccaaaatatatcattcgcaaaactagaatcagaaaagaagaaaagagtaatagccgttaatggagcaataacatctaaactcagagcaagatggggttttaacaaaatacgagaaaatggagacgaacatcatgcacttgatgcgttgatagtagcgtgtgtaacagacaaatacataaaagagataacgagcttttcaaaacgaaaagaagttagattcaacgaaaacttgtggaaaagggagaaaacaccacaagaaatagaacaagaagtagtacactttaagaaagattacgatcgaatattcaatcaagccttcccattaccctggacaaacttccgcgaagaagtatcatgcagaatgtctgaaaacccagcagaactaatgaaaaatcatacatgggaaacatatacagacgatgaaatagcagctctacgacccattttcatagtaagaatgccaaatatgaaaacatcaggtcccgctcatcaagaaaccataagaagtggtaaactagaagaaaaaggattaaacatatcgagggtaagcatagaaaaactaaaattagataaagaaggaacgattaaatcaggtaacgcacaattttacaaagattcaggaaatggttggcaactgttacacgacaaactcaaagtggccttggaaaaacatgacggagatggtagtaaagcattcccggacggagtgttcaaatatcaatacttagataaagaacacactgtaagaaaagttagattagtagcaaaatcaacgttacaaacatcactgaatgaaaagaaatcagtagcagacaacggatcaatgataagaatagatgtcttcaggaatgagcaagggaaataccaatttgttcccatatacgcaaaagatcgagttgcaaagaaactacctaaccaagctgtcgctgtaggaaaaatagcaaaagaatggccactaatagaagaatcagattttaaattttcactttatagcaatgatctaatcagggtaaaacacaagaaaggcgtaaaacacgtatctaaagacggaaacaaagaagaaaaatccaaaacagactttttcggatactatacgggagccgatatcgctacagcaagtataagcggcatatctcctaacaatttcttcgaatttagatcaatgggattagcaacattaatcagcatcgaaaaatacaaagtagattacttcgggaattaccaccaagtaaatgaaaaagtgcgccaaaaattccctaaaaacaggatgtga

SEQ ID NO: 5074 - RNA, 3312 nt, synthetic construct
  misc_feature 1..3312: note = Cas9 variant
  source 1..3312: mol_type = other RNA
atgaaatatgacataggcatagacatcggtgtcgcaagtgtgggagaagcagtaatagatcaggagggaaacatccttgaagcttgcagtaatttattcgatgaggcagatgccgcatcaaatgtagacagaaggaactttagagagggcagaagaaataaaagaagagaaagaacaagagtaaatgattttaaaaaactatggacaaaatttggatttgaaataccgaaaaacgtaatgaacgatacaatattactaaggaacaaaggaataaagtgtgaattagatctaacggaactctacagcgtattattatacatgttaaaacatcgaggaatcagctacctcgaagacgccatagacgaagccaaagggtctaactacgccaaaggcatagccttaaaccagaaagaactcaaagaaaaattaccgtgcgaaattcaacttgaaagactaaaaatatatggaagttacaggggagattgtatagtaaaaaaagaagatgaagacgaatatcactcaaacgtgtttactataagtgcatacaaaaaagaattagagatactatttagaaatcaaaaactaccagaagaatttatacaaggatatatgaaaattttcgaacgaaagagggaatactatatcggaccaggaaacgaaaaaagtcggacagactatggagtatacaccaccaataaagatgaagaaggacactacataactgacaaaaacatattcgaaaaattaataggaaaatgtagtgtttataaagacgagtttagagcagcaggcgcctcctacacagcacaagaatttaacgtattgaatgacctcaataacttaacagtaaacaacaggaaactgacagaaaacgagaaaaaaaaaatagtggaaaaaatcaaaagctcaaatgcagtgaacatgaggtcaataataaaaaaagttttaggagaagatatcgaacagtttggtggtgcacgaaaagataaagcagacaaagaaatatatcacacatttgaagtatatagaaaaatgaaaaaagagttcgaaaaaaacggcatcgatatcgcagacttttcgcgcgaaaaattagacgaaattggaaatatactaacactaaataccgaaacagaaggaattaaaggcgcactgcacgaagctaaaaattcattcacttactcagaaatagagacacttatagacatacgcaaaaaaaactcatcacttttttctaagtggcaaagcctatcactaaaaatcatgaacgaactaatacctcaaatgtacgcacagcccaaagaacaaatgcaactattaacagaaatgggagttttcaaattcaagtccgtaaaatttaaaaacagtaaatatatacccgtagaagaaataatcaaggacatttacaatcctgttgtcgttagatcagtaagaacaacaatcaaaatgataaacgaaacaatacgaaaatacggataccctgacaatatcatcatagaaatgccacgcgataaaaacagtaccgaagaaaaagaacgaataaaaaaagaacaatcaaaaaatgaaaaagaatatgaaggaatactaaaaagaataaaggatgagtatgacatagaaattaatagagatgactatagaaaacaagaaaaactagctttaaaactaaaattatggaatgaacaagagggaagatgcccatactctggtaaaatgatcagcatatacggattattagaagacccacagttattcgaaatagatcacataatcccaaaatcgataagttttgatgactcaaggaataataaagttttagtatatcgaagtgaaaatcaaaaaaaaggaaataatacaccttacatgtatttaagcaaaggcgataaaaactggaactacgatcaatataaaagttatgtgctgggattaaagaacaaaggaaacatatcagacaagaaggtcaacaacatgctctttatggaagacattaacaaaattgatgtgttaaaggggttcataacacgtaatcttaacgacacaagatatgcttcacgagtagtactaaatatgctacaaagcttcttcaatgaaaaagatggttgtcccaccaaagtcaaggtgataagaggatcgtttacacaccaaatgagagtaaatttgaggatcaataaagacagagacgaaagttatagtcaccatgcagtagacgcaatgttaatagtatacagtcaaaggggatacgaagcatatagaaaaatacaagaagcctgtgtagactttgaaacgggagaaataatagatgaagaaaggtggcaacaatgcatatggggcaaagattacgaccaagtaatgtacgaagcaaagtggagcaaaatccgagaaaaaataatagaagcagaaaaaaatgttaagtatcaccatcgagtcgacaaaaaagtgaacaggggattatgcaatcaaacaatatatggtaccagaataaaagacgggaaaatatacaaaatatcatcctacaatatatacgacaataaagaatgtgccagtctactcaaaatgatcaaaggaggaaaagaaagcaaaatcctcatgtacaactacgattcaaaaacgtacagagacatgatcaaaataatagacgaatattcagacgagaaaaatccatttgtagcatatatgaaagaaacaggagactactttcgaaaatacgccaaaaaacacaacgggccaaagatagaaaaagtcaaatactacaaagaagaggcaggatcatgtatagacatatcacacaaatacggatatgaaaaagggtcgaaaaaagtcatactgggatcattgaacccctatagaacggatgtcttctttaatgaaagattaaagaaatattatctaattgggataaaatataaccacatcaaatgcgaagggaataactacgtaatagatgaagacgcatataacggattacttagagacgcaggagtcataagtcatgaaaatacaatcaatgatttggaaaaggtcggagtaaaatacttattcagtctctataaaaacgatatcataaaatacgaaaaaaatggcgaaatgtttgttgaaagattcttatccagaactatggaatatgcaaataattacatcgaaacaaaaccaattcacaaaccatttttccaaaagaaagacaaaaaaggaaacataaaaaatagccaaaacctcgtaggattgagcaaaacaaaatacataggaaaactcgtaacagacgcattaggcaatacttacatggtagaaaaagaaaagttttcactaatcgtcgatatatga

SEQ ID NO: 5075 - RNA, 3315 nt, synthetic construct
  misc_feature 1..3315: note = Cas9 variant
  source 1..3315: mol_type = other RNA
atgaaacttatattagccttagatatcggcatagcatctgtaggatgggcagtattagacaagaaaagtgaaacagtactcgaagctggctcaaacatctttccagaagcaagtgcagccggaaatcaagtaagacgagaaatgagacaagcaaggcggataaaacgaagacaaaggaccagattagatgacttcaacaaactgtggcggaaaaataacctaagtataccccaatataaaagcaccgaaatagttaatctaaaagtaaaagccttaagagaagaaatatcactcgacgaactttacctaatattatactcttacttaaaacacagaggcatttcttatttagaagatgcacaagacgactccctttcatcttcaaacgcctatacaaatggactacgagaaaacgcaaaagctctagaaaaacactacccatgtgaaatacaaagagacagactacaaacgattggaaaatatcgtgggcaaacgcaaataaccgacgacaataatgagaaaatagatctatctaatgtatttactattggagcatacaggaaagaaatcaagaaagtactggaaacacaaaaactctatcataatgaattaacggacgaactatgtgacgattacatattaatatttaaccgaaaaagaaaatattatgaaggacccggcaacgaaaaatccaggaccgactatggacgatttacaactcgccttgatcaaaatgggaactatatagacgaagaaaatattttcgaaaaacttataggaaaatgctccgtttaccctgacgaacttcgtggagcagcagcatcatacactgctcaagaatttaacctcctaaatgacttaaacaacctcacgataaacggaaggaaattggaagaaagcgaaaaacacgccattgttcaaagaataaaaacaagcaacacggttaacatgagaaaaataatagcagattgcatgggcgaaacaatagaaaacttcagtggagcgcgaatagacaaaagcggaaaagaacaattccacaaattcgaaacatataacaaaatgagaaaatcactatcagaaataggaacggatattgacgaattttctcgagatgaactagacaaaataggatacattatgacaatcaacacagataaagaagctctaatggaagcattcaacgaaagcgggttaaacctagacgactcagtcaaagaatgtctgatatcattccgaaaagccaattcatcgagctttagcaaatggcaatcattcagcttaaaaataatgaatgagttaattccagaaatgtacatacaaccaaaagaacaaatgaccttactaaccgaaatgggagtagcaaaaggctcatcaggtgacttcgccggactcaattacataccagtagatgtaataagtgacgaaatatataacccagttgtcagaagatctgtccgaatatcatttaaaattctaaatgcagttctaaagaaatataaagttttagacacaatagtaattgaaatgcccagagacagaaactctgatgaagaaagaaaaagaataacagacagtcaaaaactaaacgaaaaagaaatggagttcatagaaggaaaactagcccagatctataacatcaaactttcatcatcagatttcagttcacaaaaacaactcagcctaaaactaaaactatggaacgaacaagacggaatatgcctatactccggccgcactatagaccccgaagacatcatcaaaaacccggatctttttgaaatagaccatataataccaagatcaatctcatttgatgattcaaggtctaataaagtcctagtatacaggagtgaaaaccaaaagaaaggcaatcaaaccccgtacttctacataactcactcagatggagcatggacctatgaacaatttaaagcaaatgtaatgaatttaagcaaaaagaaagaatatgcaataagcagaaagaaagttcaaaacctactctactcagaagatataacgaaaagagatgtattaaaaggtttcataaatcggaatataaacgatactggttacgcaagccgagtagtactcaataccgtacaaaacttcttcaaagcaaaagaagcagatacaaaagtaaaagtcataaaagggtcttatacacatcaaatgagatcaaacatgaaacttgacaaaaacagagatgaaagctattcgcatcatgctgtcgatgcgatgttgatgggattctccgaaatggggtatgaagcatacagaagattacaaggagagttcatagactttgaaaccggtgaaatccttaaaaatgatatgtggaatgagaaaatgagtgacgacgtttacgtagactacctatacggaagaaaatggtcagccataagaaacgaaatcgtgaaagctgaaaaagatgtaaaattttggcattttattgttagaaaatcaaaccaaggactatgcaatcaaacaataagaggaacgagagaatacgacggaaagaaatacaaaataaataaattcgacataagaaccaaagaaggcgtcaaactatttaagaaactagctttctcggaaaaagaatccgatagagaaaaactattagtatatctaaacgacagacagacattcaacaatctagtaaaaatatttgaagactacaaagatgcgccaaacccattcgtgcaatatgaaaaagaaacaggcgacgtagtaaggaaatacagtaaaagacacaatggacccagaatagacaaactaaaatacaaagatggcgaagtaggggcgtgtattgatatatcacacaaatacggactcgaaaaagactcaagaaaagtcattttggaaagtttagtcccctatagaatggacgtctactacaaagaaagtgataaaatgtactatcttgtgggagtaaaacaaagtgacataaaatcacaaaatggtgccaacgtaatagacgaagatctatacacccgcatattaataaatgagaaaatgatagaaccaggtcaatctagagacgacctcgaacaattaggatatgaatttagattcagtttttacaaaaacgatataatagaatacgaaaaagaaggaaaagtattcgtagaaagattcgtgtcaagaacaatgccaaaagtacgcaattacatagaaacaaaaccaatcaacaaagccaatttcgaaaaacaaaatccagtaggtttaggaaaaactaaatctatcaagaaatacagaacagacatcttgggcaacagatatttatgcgaaaaagaaaaatttacgaaattttgctga

SEQ ID NO: 5076 - RNA, 3315 nt, synthetic construct
  misc_feature 1..3315: note = Cas9 variant
  source 1..3315: mol_type = other RNA
atgaaccactatgtactaggactagacatcggcatcacatcagttggctatggcgtcatcgatttggataattatcaatttgtggattacggagttagattatttaaggaaggaaccgcagaagataatgtaaataggagaactaaaagaggctctaggagacttaaaagaagacgtcaaactagactagacgatatgaaagaactactacaaaaagaaaaaatcatgtcagaaacatatcatagcagctatgatccatatgacatgagaataaagggactatcccaaaaattatcaaacgacgaacttacctgtgccatactacacatcaccaagtgtaggggaacaactctagaagcactagactcagccgatgaagactccgaaggaacaaaatcaatactgtctaaaaacgaccaagacctcaaaaaataccactacgtatgtctcgtccaaaaagaaagattaaaacaatccggaaaaattagaggtaccgaaaataacttcaaaaccgacgattacataaaagagttagacgaaatattatcacaccaagacctttccgaagacttatgtgaaaaaatacgtaccatagtaagcaggagaagacaatactacgaaggccccggatcagaaaaaagccctaccccatatggaagatggatagcccaaggagtagccccaatcgacttgatagaaaaaatgagaggaaaatgctcagtttttcctgatcaactacgtgcagctaaaaactcatacacggcagaattattcaatcttctaaatgacctaaataacttggaatgcgaaggagaaaaattaacgacatcacagaaacaagatgtcatagacttcgtaaacgaaaaagggggcatcactcccaaacaacttgcaaaattgctcaacgttgacttaaaccagataaaaggattcaggatagacaaaaatgataaaccattactaacagagtttaaaggttataaagctttcaagaaaatatttgatactaataactgtgatctatataaaaaagatctctcaattcttgatggcttagcagaaatagtaactggtaaaaaagggatcgaagaaagaaaacaagcaatccaacaagcatacccagaaatcgatgaagccatagtcgaacaatgcgctgtaatgaaaggaatgacacaatatcattctctatccctaaaagccatgcatcttattaaccaagaaatgctacaatcaccaagaaatcaaatgcaagtcctccatgaatcacacgtattcgacaaaaacagagtaagtcacaaaggacaaaaatacatagaggcagatgatgaagcaattttatcacctgtagtaaaacgagcacagagggaaacatttaaagtagtaaatgcactaagagaaaaatatggtgagtttgaatcaatagtagtagaaacaaccagagatagaaactcacaagaacagaaaaagcgactcaatgactcacaaaaatactacgaacaagaaaacagaaaggtagacgaactcctaagtcatgaaggctacgaccctagcaagataaatgggaaaacaaaactaaaagtaagactatacttacaacaagaaggaaaaacagcatatacaaatgcacccatagatcttaatttactgataaaagacgcaacagcatatgaggtcgaccacattatacctctatcaataagtttggatgatagtatcaacaataaagcattaataaatagaacggaaaaccagaataaatcaaacatgacaccaatctatgccatcctacgaggaaaactcaatatatctctagatacatataagaccgtagttaaaaacaacagaaattacacaggcaaaaaaaggagttatctattatacgataaagatataaccaagttcagtaacatgcaagaattcatagctcggaatttagtcgacacatcctatgcctgtcgagtagtaatgtccacattatcagactattttaaagacaatgaaatatcaacacatgtacataccgttagaggccgcgttaccaacatgttccgaaacagaattaatatgcagaaagaaagagaaaaagattacttacaccacgcagtagacgcattaatcgttgctagcataaaaaaattaaacttattaaacacctatttattaaagtacaatttcaatgacttatataacgaagaaaccggcgaagtcttcgcagtaggagacgatcaacaagtcctggacccaaaatacataagattcatcactcaactgaaaacaatatacgacgaatcaaatatgtactacaatggattaatagaacgtaatgttatgcaattcccaccaataaaaatctcgcacaaaattgatacgaaaccaaacagacaaataagcgatgaaactatttattccacccgaaccgtaggcaacgaagaatacgtagtaaaaaaatactcagacatatacgaccccaaattcacccaactaaccgacgatataataaatgatcggccattagacagatggctaatgtatcgaaacgacaaccaaacatttaaaataatacagtcgatcatattagaccatttccacatattcaaagacgacgaaaaacactatagttgtacaaaaaaaaaaggccaaatacagtatgccctaaaagggaagaatcccttatacctatacaaacaagaacatggaaaagtacgtaaatacgcaaaaaaaggaaatggaccagaaatcacaatgatgaaatatttcgatggcaaactcggaaacaacatagacatatcaaaccattatcatgtccacaacaaaaaagtcgtactactccaaatcagcccatacagaacagatttctacgtatcaccagaaggaaaatacaaaatgctaacagtaagatatgctaacgtcttttataaagagtcaaaaaagaaatacgtaatagatgaaaaatggtacgcaagcgagaaaaaacgcaaaaacataaccgacgacgatatcttcgtatgtagcctacaccacgatgagttaataggcatacaaaaaaaagacggagcaaaatatgtttacgaccttagtactgaggacggaggtaaaccaagattataccacggtgaaatggaaatactaaagtttacagccacaaataatgattctaaaaacattatcgaagtcaaaccaatatacacatattgcaagaaacaactaatgataagcataggtccaattacaaaacttgcaaaatacgcaacagatgtactaggaaatgtatatgaagtaaaaaaaaacattatagaccacctttcacacttatga

SEQ ID NO: 5077 - RNA, 3318 nt, synthetic construct
  misc_feature 1..3318: note = Cas9 variant
  source 1..3318: mol_type = other RNA
atgggcatacgaattggactagatattggaatagcatccgtaggatgggcagtagtagacgacgattataacataatagaatcaggagcaaacatattcaacgaagcaaaagcagcatcgaacgtagaccggagaaccttcagacaaacgaaacgattattaagaagacagaaaacacgattaagagattttgacatattatggataaacgctggattagacatccccaaagaaaaagtaaacaaacaattacaatttagagttcaaggcatgactatggaactgagcgaaaatgaactatatgcagcacttaaaaatatgctaaaacacagaggcataagttacttggaagacgctctcgatgaagaacaaagtggaaaaagcacatacgaaaaaggcttacaagttaaccaaaaagccttaaaatgtgataaaatgccctgcgaaatacaatacgaacgtcttatgaaatacggatcatatagaggccatatcgaagtaaaagacgaatcaggagaagaaatgatcctatcgaatatctttacattagacgcatactgcaaagaagccaagaaaatattagaatgtcaaaaacaatatcactccttcattacagaggcttttgaagatgattatctagcattgttgagaagaaaaagaaaatactacgaaggccccggaaatgaacaatcaaggacagactacggcaaatacacgactaaactcaacccagaaacaggcgaatacgtcactgaagaaaacatatttgaaaaactaattggaaaatgctcggtctacccaaaagaaatgagagcaagcgcagcctcatatacagctcaaatatataatatgcttaatgatttaaataacttaaccataaatggcagaaaactagaatatgaagagaagaaaagtatagtagaagaagtacaaaaagcaagcagtgtcaatatgctaaaaataatcaagaaagtaataaatgaagatataacaacaatagaaggagcacgtaaagacaaaaacgataaagaaatattccataaaatggaaacctacaacaaaatgcgtcattactttgagaaaaatggactagaatttaagaaaatatcaacagacgacttagatgaaataggtaatatactcacacttaatacagaaaaagaagcaatattagaggcttttaataaatcccaactcgaattatcacaagaagaaaaagaagcgtttatagaaatcaggaagaaaaacggtagccttttcaacaaatggcacagtttctctctaaaaataatgaaagaactaataccagaattatatctacaaagtaaaaaccaaatgcaactacttacagacatgggagttttcaagaagaaaacagaaatattccaaaattacgataaaatacccacggatgtaatcatagaagacatatacaacccagtagtaaaacgtagcataagaattacagtgaaaatagtgaacgcactcatcaagaaatacggatatccgagagaagtcgtcatagaaatgccaagagatagaaacagcgatgaagagaagaaacgcattcaagacgaacaaaagaaaaacgatacagaactaaagaaaataatagaaaaagtcgaatcagaatacggaataaaaataacagacacccactttagaaaccataaaaacctaagaatgaaactgagattatggcacgaacaagacggccgctgcctatatagtggcaaagtcatagatatctcagaactactaaacgattgcagtaaattcgaaatagatcacgtaattccaaaatctatatcattcgacgattcaagaagtaataaagtattagtctacagcacagaaaaccaaaagaaaacaaaccaaacaccataccaatatttggagggaaacggaaaagaatggtcattcgatgaatacatgaaccaagtgatagagttaaaagacagaaaactaatatccaaagcgaaaatgaacaaattattattcagagaagatataacaaaaatagaagttctaaaaggattcatagctcgtaacattaacgatactcgttatgcaagtagagtagtactaaattcattccagaaatattttgagagtaaacaatcagacacaaaagtcaaagtaataagaggatccttcacacaccaaatgaggaagaaattgcaattgagcaaaaatagggatgaatcctacgcacaccacgcagttgacgcaatgttgatatgctacagtcaaatgggatacgaggcttacagacaattacaagaagatttgattgatccggactcagagaaaattcgcgacctcgggctatggaaagaaactataactgaagcgaaatatgatgaagtactatacaccgcaaaatggctcgaaaaccgaggaaaaatacaagaagctgagaagaaagtaaaattctggcataaagtagacagcaaagcaaacagggcattatgcaaccagactataagaggaactagagtaatagacggaagcatacaaaagataaataaaattaatatatactcagtggatggatataaaacgtttaaaaacatgatccaaaaaggaaaagaaaaagatttcctaatgtacagaaatgataggagatcctgggacgacttaatgaaagtctaccgagaatactcagacgccaaaaacgcgttcgcagcataccaagaagaaacgggagattatgttagaaaatatgcaaagaaacacaatggatcaaaaataactaacctgaaatactgtgccaaagaactagggagttgcatagacatcagccacaaatatggtctggaaaaagactctagaaaagtaattttggaaagtctaagcccttataggagcgacgtttactataacgcaggcttaaaacaatactacatagttgggatcaaaaatagtgatctctgctttttaaaaggagagtactttatagactcaaaaagatatttacaaatactcagggaagagggcgtcctgaccgaacaacacaccttaaatgatttagcagctataggcacagagttccaattcagcttgtacgaaaacgactacctagaatatgagaaaaatggagaaataaaaacagaaaggttcttatcgaggactaaacctaaacagaaaaactatatagaaacaaaatcaatagatgcgcctaaaattaaaaacaagaaacaaaatcttgtgggacttgcgaaaagcaaaagtataaagaaaataagagtagatatattaggtaatcgatattatgcaagtaaagaaaaatttagcttaatggtagacaaattctga

SEQ ID NO: 5078 - RNA, 3318 nt, synthetic construct
  misc_feature 1..3318: note = Cas9 variant
  source 1..3318: mol_type = other RNA
atggatatggcttggagactaggactagatctaggcacaaattctttgggttgggcagcattaagcctagatgcagcaggagcaccagacgctatattagcagctggatcaagaatatttggggacggtcgtgatcctcagagtgggacatcacttgcggtagacaggagagccgctagagcggcaagaagacgaagagacagattcaaacagcgacaacgcgcacttttaaaacacctggaagcagatggcttatttcccgctgatcccgaggtacaacaagctctagcagctttagatccgtatgctttaagagccagagcattagatgaagcactatcacttcatgaaataggacgagccttatttcatttaaaccagagaagagggtttcaatcgaatagaaaagcagataggggaaaagatgaagacgcgggaaagatagcgataggagtagatagattaaaagacgctattgcggctgctggagcacgaacctttggtgaatttttgcgtcaaagaagggctggagcaaccggagagaaccaaattcctagtgtaagaacaagactgagggcggagacgggagaaggagcgaaagggagtggatatgacttctacccatcaagagcgttactaaaagacgaatttgacgcgatctggcatgcccaagcagaacaccatcccaaagtattaactgatgaagcctatcacagactacacgaaatagtatttcgccaaagaccactcagagcacctaaagtgggggcatgcacattagttcctggggaggctagattgccaaaagcacatcctttatttcaaaggagaagactcttagaggaattaaatgcactaatgatagtaagggctggagcggtggcggaaaggttaactccagaacaaagagacctactattactgaaacttaaggataaaggcaaggttacatttaagtcattacgtgaaaaagttttaaaacttgacggtgatgctagattcaacaaagaaagtgaacataggacagaacttaaaggagacgaagtagcagcagaaatgggtggaaaaacgaggtttggttcactctggccccatctgtcaacagagcaacagtggacagtaatagaaagacaacaagcgctagaatcggacgcagacgaagcggcgtttagaacatggctagtggagacacataaactcacagcagaacaagcaagagctgtagccggagcacgcttacccgccggacacggaaggttcggactcacggctaccgctgcacttttagcagcattacgggatggccgcacacctgagggaagagggcccaatgcgccagctactgaagcaggaagagtagttgtgtactcggaagccgcagcaatagcaggatatcaccatagcgatcataggagtggtgaggtattcacagatgcaaagggtaggcctgcattaccttactatggagtgccactcgatcgacatatagtacctggaacagcagatccagatgagcccgacgaagccgcacgtatagggagattgacaaacccgactgtacatatagcactaaaccaattacgtcgagttgtcaataggcttataagagtatatggaccaccagcagaggtagcattagaattagcgagagaactcaagttaagtgaagacgaaaagaaagagagaaatcgagaaaattctaggaacagacttgatgccgaaaagcgaagttctaaattagccgaattagggcagcgagacaatggtggaaatagagcattattaaaactttgggaagaattaaacccagaaaatatattagaccgtcgatgtatatactcaggtcgacaaatcagtattggaatgattttctcaggagctgctgaagtcgatcatatacttccttttgatgcaacattagacgactcaaacgctaataaaattttatgtttacgagaagccaatagagataaaagaaaacgtagtccttttgaagcctggggtgggacacctcaatgggaagagatagctgagagggcaagtcgtttaccaagaaataaaagatggaggtttgaaccagacgcaatggaaagatttgcagaagaaggtggttttctagctagacatttggtagacacacagtatttaggacgaattgctcatgactatttaagatgtttatatccagacaaaggcgatggcagctcacacgtctgggtatcaccgggaagactaacagaaatggtacgaagaaaacttggattaaatggattgttaggtgatcataatctaggagcagaacaacctaagaacagaaaagatcacagacatcacgccatagatgcagttgtaacagctatattagatagatcaatgttacaacgtattcaacgagcttctggtgagggggcgtctgacgcagaattgctgaggataatcgtccctgagccttggacgggatttcgagatgacttacaaagagccgtggacaggatagtagtcgcacatagggcagatcatgggactgttgcgaaagcagcaacacgaggtagagatcaaacagctgcacgattgcacaacgatacagcatatggatttacaggagaagcagatgctaaaggaacacctattgtagtacacagagcaccactaggagcattaaagaagcccgaacacattgatcaagtaagagatccattattaagagcagcacttcacgattttaccgctggcctatcaggaaaaccattcgaggacagaatagcagcatttccaagattaggaccactagactatcgaggtataagacgcgttagagtagttgaacctctacaagttataccaataagagatgcagctggcagagcttataaaggttataaaggtgattccaattatcgatatgacgtatgggaattacctgacggaaagtgggaacaaagggttttgcaaatgtattacgctcatcaatcaggagaaccacctaggccccaccctgctgctagaaaggtcctttcacttcatagagatgatgtactagccattgaaagaggtgaaggaggtagagaattagtacgtgttgtaaaattttcaacaaatgaatttactctggcaccgttaaatgaaggtggggctctcaaaagcaggcacgccgacaagggcgatccgttcagatatttatatccatctccatcaactttaaaagcgtggagagcaagagaagtaagggtcgatgagcttggacgagtattagacccagggtttccggcaaggaaaagaagaagagttacaagaccggggagagcagatgctgattga

SEQ ID NO: 5079 - RNA, 3321 nt, synthetic construct
  misc_feature 1..3321: note = Cas9 variant
  source 1..3321: mol_type = other RNA
atgcaatacattgtggctatagatataggtgtggcatcagtagggtatgcagtaatagacaaaacaagtgaaacggtgatagaagcaggctcaaacatatttccagaagcaagtgcaacagacaatcaagaaagaaggggtatgcgacaagccagaagattgaaacgccgagaaagaacaagattagacgatttcaccaaattatgggaataccacgggcttgcaataccacaagtcaagaaaaatgacattgtaggactaaaagtaaaagcactctacgaatccatcagtttagatgaagtatacctaatactctatagttacttaaaacaccggggaatctcatatttagaagacgtagaagattcatcggtatcaggaagtacagcttatgcaaatggtctaaaactaaatgcaaaagaactagagaaaaacttcccatgcgaaatccaaaaatacagactagaaaacataggaaaatatagaggacaaatacaaatagaagatgaccaaggagaaaaattagatttaagtaatgtatttacaattggagcttacacaaaagaaatacaacaaatattagacacacaaaagaaataccatgcagaaatcgaagacgagttctgtgaaaaatacctaaaaatattcacacgaaaaagaaaatattatgaaggtcctggtaatgaaaaatcaagaaccgattacgggaaatacacgaccagactcaaagaaaatggagaatatataactgagaaaaatattttcgaaaaactaatcggaaaatgctcagtatacaaagatgaactgcgagccgcttcagcatcatacacggcacaagagttcaacctgctcaatgatctcaacaatctaaccgtaaatggaagaaaactagaagaaaatgaaaaacacctcatagtcgacaaagtgaaaacgagtaatacaatcaacatgagaaaaataatagcagacgcaatgggtgaaaagattgaagagttctacggagcaagaattgacaaaagtgaaaaagaaatattccataaatttgaagtatataacaaaatgagaaaagcactagcagctatccatgtaaatatagaagagttcagcagagacgacttagacgaaataggatacatacttaccataaacaccgataaagaagctatgatggaagcatttgacaattcccgattagaattaccaggcgaaatcaaaaactgcctaattagcctacgaaaaactaatggcactctatactcaaaatggcactcgtttagcttaaaaataatgaatgaattaataccagaaatgtacaggcaaccaaaagaacaaatgacattactaacagaaatgggagtaatgaaagggcaaactgatgagttcgagaaaaataaatacatccccgttgacgtagcgtcagaagacatcttcaatccagtagtaaggaggtcagtacgcattagctttaaaatactaaacgcattaatgaagaaatatggaactttagacgaagtcgtgatagaaatgcccagagacaggaatagtgatgaacagaagaaatgggaaaaagaaacacagaagaaaaacgaaaaagaacaagaatatatagaaaacaaactagctacagtgtacgacataaggctttcgtccgcggacttcagctcccaaaaacaactgaatttaaaactgaaattatggaacgagcaagacggaaaatgtttgtactccggaaaaatcatagaaccagaagatttaattaaacatagtgaactattcgaaatagatcatattatccctagatcgatttcattcgacgatagtagatcaaataaagttttagtatatagaacagagaaccaaaacaaaggcaatcaaacaccctactactacttaacacacactaacagtaaatggtcattcgagcaatataaagcattagtaatggacctgtctaaaaagaaagaatatggacttagcaaaaagaaagtaagaaacttattatacagcgaggacatcaccaaagccgatgtactaagaggattcataaaccgtaacataaacgatacatcctatgcagcaagagtagttcttaatacagtacaaggatattttcgagcaaaagaaatgggaaccaaagtaaaagttatcagaggaagttacacacaccaaatgagagtgaacatgaaattagataaagaccgagaaaaatcatacgctcatcatgcggtagacgcaatgctaatagcatttagtcaattaggatacgaagcctacagaaaattacaaggagaatttatagattttgagaccggtgaaatattaaacagcgaaaaatggaaagaccaaatgtcagatgaggtatataaacaatacctatatagaaagaaatggtctaatattcgaaacgaaataacaagagctgagaaaaacgtaaaatactggtattatgtagatcataaaagcaatcgcggactctgcaatcagaaaattaggggaaccagagtgtacgatggaaaaatctacaaaataaataaactggacatacgcaagaaagaaggagcagcactatttaagaaactagcattttcagaaaaagaaagtgatcgagaaaaactattagtatacaaaaacgataagaaaacctacgaagatctagttagaataatgcaagactactctgacagcaaaaatccgtttgtacaatacgaaaaagaaactggcgattatgtaaggaaatatgccaagaaacataacgggccacgcattgataaactaaaatacatagacggggaagtaggatcatgcatagatatatcacacaaatacggctacgaaaaaggcagcagaaaagtagtgctagaaagcctagtaccttataggatggatgtgtactacaagaaagaagaacaaacatattacttagtgggaataaaacaatcggatgtgaaatgtcaaaaaggagaatacgttatagatgaagacgcttacgccataaacctagttaaggagaaaatgatacaacaagggcaaaagagaagtgatttagagtcacttggttttgagttccaactatcattctacaaaaacgacataatagaatatgaaaaagatgggaaaatagtaagagaaagatttttaagcagaacaatgccgaaagtcaaaaattacattgaaacaaaaccaattgacagagcaaaatacgaatggcatgatagaaagctagtaggattagggaaaaccaaaagaattagaaaatatcgaatggacatcttagggaactactacttgtgcaacaaagaagaatttagcaaatactgttga

SEQ ID NO: 5080 - RNA, 3324 nt, synthetic construct
  misc_feature 1..3324: note = Cas9 variant
  source 1..3324: mol_type = other RNA
atgggctacaccgtaggattagacataggagtcgcgtcggtaggagtagcagtactagatgagaatgataacatagtagaagccgtaagcaacatatttgatgaagccgacacctcgaataacaaagtacgtaggacactaagagaaggaagacgcacaaaaagacgtcaaaaaacaagaatagaagactttaaacaattgtgggaaacaagtggctacataatacctcacaaacttcatttaaacatcatagaattaagaaacaaaggactaacagaactcttatctttagacgaactatattgtgtactattaagcatgttaaaacacagaggaatatcctatctagaagacgccgacgacggagaaaaaggcaacgcatacaaaaaagggcttgcgtttaatgaaaagcaactgaaagaaaaaatgccatgcgaaatccaattagaaagaatgaaaaaatatggaaagtaccacggcgaatttataatagaaatcaatgatgaaaaagaataccaatcaaatgtattcacaactaaagcctacaaaaaagaactagaaaaaatcttcgaaacacaacgatgcaacggaaataaaataaacacgaaattcatcaaaaaatacatggagatatatgaaaggaaaagagaatactacataggaccaggcaacgaaaaatcccgaacagactatggtatttacacaacgaggacagatgaggaaggcaacttcatagacgaaaaaaatattttcggaaagctaataggaaaatgttcagtatatccggaagaatatcgcgccagcagcgcatcatacacagcccaagaattcaacctgcttaacgatctaaataacctaaaaataaataacgaaaaattaacagaatttcaaaaaaaagaaatagtcgaaataataaaagacgcttcatctgtcaacatgaggaaaataatcaaaaaagttatagacgaagacattgaacaatatagcggcgcacgtatagacaaaaaaggaaaagaaatataccacaccttcgaaatatacagaaaactaaaaaaagaactcaagactataaacgtagatatagactcatttacgcgagaagagttagataaaactatggatatactaaccctcaacacagagagagaaagcatagtaaaagcattcgatgaacaaaaattcgtatatgaggaaaatttaataaagaaactcatagaatttcgcaaaaacaatcaaagactattctctggatggcactcattctcatacaaagcgatgttacaattaattccagtcatgtataaagaaccaaaagaacagatgcaactactaaccgaaatgaacgtatttaaaagcaaaaaagaaaaatatgtgaactacaaatacataccagaaaacgaagtagtgaaagaaatctacaaccctgtagtagttaaaagcataagaaccactgtgaaaatactaaacgcattaatcaaaaaatatggctatccagaaagcgtagtaattgaaatgcctcgtgacaaaaattcagacgatgaaaaagaaaaaatagatatgaaccaaaaaaaaaaccaagaagaatatgaaaaaatactaaacaaaatctatgacgaaaaaggtatagagatcacaaacaaagactataaaaagcagaaaaaactagtactaaaactcaaactatggaacgaacaggagggcctttgtttatactcaggaaaaaaaatagcaatagaagatctattaaaccacccagaattctttgaaatagatcacatcatacccaaatcaataagccttgatgactcaagatctaacaaagtactggtttataaaacggaaaactcaataaaagaaaacgacacaccctaccattacctaactcggattaacggcaaatggggcttcgatgaatacaaagcgaacgttctcgaattaagacgaaggggtaaaatagacgacaagaaagtcaacaatctactgtgtatggaagacattactaaaatagacgtcgtaaaaggatttatcaaccgaaacctaaacgacacgcgatacgcaagcagagtagtactaaacgagatgcaaagcttctttgaaagcaggaaatactgtaacacaaaggtaaaggtcataagagggagcctcacatatcaaatgcgccaagacctacacctaaaaaaaaacagagaggagtcatactctcatcatgcagtagacgctatgctaatagcattctcacaaaaaggatacgaagcataccgaaaaattcagaaagattgctatgactttgaaacaggtgaaatattagataaagagaaatggaataaatacatagatgacgatgaatttgacgacatattatacaaagaaagaatgaatgagatccgaaaaaaaattatagaagcagaagaaaaagtaaaatataattacaaaattgataaaaagtgtaacagaggactatgtaatcaaacaatatatggaacacgagaaaaggatggaaaaatccacaaaataagctcatacaatatatatgatgataaagaatgcaacagtttaaaaaaaatgatcaacagcggaaagggaagcgacttattaatgtacaacaacgaccccaaaacctatcgagacatgttaaaaatattagaaacatactcaagcgaaaaaaaccccttcgtagcatacaataaagaaacaggagactacttcagaaaatacagtaaaaaccacaacggaccgaaagtagaaaaagtaaaatattattcagggcaaataaactcatgcatcgacatatcacataaatacggacatgcgaaaaactctaaaaaagtagtactcgtctctttaaatccatacagaacagatgtgtactatgataacgatactggaaaatattatctagtaggggttaaatacaaccacataaaatgtgtcggcaataaatacgtaatcgacagtgaaacctacaatgaactactaagaaaagaaggcgttttaaactccgacgaaaatctcgaagacctaaacagcaaaaacatcacatacaaattctcactatacaaaaatgacataatacaatacgaaaaaggaggggaatattataccgaaagattcctatcaagaataaaagagcaaaaaaatttaatagagacgaaaccaataaacaaaccgaatttccaaagaaaaaacaaaaaaggagaatgggagaatacaaggaaccagatagctctagctaaaacaaaatatgtaggcaagttagtcacagacgtattaggaaattgttatatagtaaacatggaaaaattcagcctagtagtcgacaaatga

SEQ ID NO: 5081 - RNA, 3324 nt, synthetic construct
  misc_feature 1..3324: note = Cas9 variant
  source 1..3324: mol_type = other RNA
atgggctatacactaggtttagacatcggcatcgcctcagtagggtttggtttaattgacaatgtcgatggaaaaatcttagaaagtggagtcaggctattttcgagcgcagacccagataataatcaaacaagaagatccagtagacaagctagaagactgaacagaaggaaagtacataggctagaaagagtagcacatcttctagaagaagcaggatttgaaaaaggagaagtgctagcaccaaccccgtatcatctacgagtaaaaggacttacagaaaaactaagcaaacccgaagtctatgcagcactatacaatctaatgaaacacagaggtatctcctatctcgaggatgtagaattagatgaggctgactccagcagtgtctcccaaaacgttgaactactaaaagaatattatccctgcgaaatacaattagaaagatatgaagaatacgggcaaataagaggtataatagaaacatacaataaagacggagagaaagaatcactggtaaatatattcccaacaggagcatacaagaaagaagcggaagcaataatactaaaacaaggacaattttacccagaattagataaagtctttttagaaaaatttacagaaatactcacagtaaaaagaccatattacgtcgggcctggtaacaagaaatcaagaacagactacgggatctatagagaaaatggagagacattagaaaatctatttgatatattaataggcaaatgcacaatatatcctcaagaagcaagggcagcaaaattctcatacacagcccaactattcgacttcttaaacgacatgaacaacatttctatagctggagaaaaattaacagaagtacagaaaagagaaatatatcatcaaataatgtccagtaaaacagtaaacatgatgaaaataatcacaaaagtgacaggttgcctaaaagaagaagtcaccggatacagagtcgactccaaatacaaagctgagttccactcgttcgcaagctacagacaatttcgcaataaaatgcttgattacggctttgatgtacaaacactaaacgtagaaatgttcgataaactcgctgccaaactaactttaaatacagaatatcaccaaataataacacaactggagagcttaaatctaggattatccaaagaactaatagagaaaatagccgattttcgaaagaaaaaccgatcactcttctcaaaatggcacagtctatctctaaaagctatgaatgaagtcgtagatgaactatggtcaacaagcaaaaatcagatgcaaatttttagtgaattaggaggattcaaatctaacatcgaagtttttaaaggacttaaatatataccattagatgcaatggttgatgaaatctataacccagtagtaagatgttctattagggaaagcattaaaatcattaatgcactacttaagaaatacggtgcactagataaagtagtaatcgaaatgccaagagactctaatgaaaaagaagaaaaagaccggatcacgaaactgaataaagagaatgacaataaaaagaaacaagccatagagaaagcacgtaatgagtacggattcggagaagaagcatacagacaacagaacgacctcaatacaaaactaagattatggtacgaacaaaaacaaagatgcttgtactcaggcgaaatcataaaaatattcgatttaattaaaaatccacatctatttgacatagatcatattatccccaagagtatttcctacgacgatagtctatcaaacaaagtattatgctacgcaaccgaaaacagagaaaaaggaaacctcacaccatacagatacttcaaaaggaaagcatcacttacatggaactacgaggcttataaaagttacgtgatagaattatataaagacggaaaaggagacctcagcagaacaaaattagaactcctactatttgaagaagatataaataagtatgaggtaagacaaagattcatcaatagaaatctcgtcgatacacgatatgccagtaaagtcgtactaaatactttacaggacttcatgaaagaaaactacccaacaacgacagttgaggtagtaagaggcaaatttactgcacaacttcgtagacactggggaatccgcaaaaatagagacgaaaatcatgcccaccacgccatcgacgctctaataatagcatgcgtacctcacctatccctatggaaagaacaaaagaaagtttttagtacagacgaatttagagtagatgaaacaacaggagaaataatcgaacaaagctataatcaactcacataccaagaacccttttcacaattcttttaccaactagaaaaagtcagcatagattgcagatattcctacaaagtagaccgaaaatttaatagacaagtagcagacgcaacaatctattctacacgtcaaggcatagtaaaacaaacaagtggggacaaaagttttacgctagacagcaactcaaaagaacattatgtgatcgcaaaaatcaaaaatatatatgaagacgtcgatgccaagagattcatggacagatacaagaaagacaaaacgcaatttttaatgtatcaccatgacccacaaacatttagcatactcgaagatgtaatgaaaacatatccagacaagaaaaatccattccaagcatacagattagaatatggaccaatacgaaaatattctaagaaaggtaacggcccacaaattcaatcgataaaatattatgattcaaaactaggccaacatatcgaattaaaacaagccaaccaatcaaccaagaaagtagtactacagagcttgaatccctggagatgcgacatatactataataagaaagacaaacgatacattgccgcgggattaaaatacgcggacctttcttatcaaaaaggaaccggtttatacggcatcagcttacaacgctatcaacaaatactcaattcagagaaaatagaactttcaatagaacaaatagaactacttctcgaaggaagattgaatgaaagcaatttcgagttctgctttagtttatacaaaaacgattttatacaatggaacgatgaaaataaccaaacatttcaatatagatttcttgcacgaaacttatcatcaccaaacaggatagaagtaaaaccaataaataaaagtaaatacgacaaacaagcagagggactaaaaacactaaagaaaggactgaacaggttctacaaaatatctgtcgacgtactaggctatcaacattttataaagaaagaaaaattaaaactaacattcaaatga

SEQ ID NO: 5082 - RNA, 3330 nt, synthetic construct
  misc_feature 1..3330: note = Cas9 variant
  source 1..3330: mol_type = other RNA
atgagccactatgtattaggattagacataggaataacaagtgtcgggtacggcataattgatctagatacaaatgacttcatagactacggcgttagactctttaaagaaggcactgcagcaaacaacgaagaccgcagaaactcaaggagcagaagaagactactatcccgaaaacatactagattaatggacatgcaaaaagtattaaaagaagcaggaataatgactgaatcatattcaccactaagtaatgtatatgaaatccgtaaaaaaggactaactaaagaactgaccaacgatgaactaactgcagcaatactacacataacaaaacacagaggatcagttatcgaaaccgttgaagatgacgaagccgcagccaaagagactggagaattaaaatccactctacacgaaaacgcactactcttagctaataacaaattcgtatgtgaaatccaattagaaagattaaacaccgaaaataaaattagaaatcataaaaataattttaaaacaaaggattacgtagctgaactcaaagaaatactaaaccaccaaaaccttagtgaggaggtaaaaaacaaaatcatacaaatagttgaacgcagaagagcctactacgaaggacccggctcatttaactcccccaccccatatgggaggttcatagaagtaaacggacaagtccaagaaattgaccttatagaaaaaatgaggggtaaatgctctgtctacccggacgaatttagagcaccaaaaatgtccataagtgccgaccttttcaacatactaaacgacttcaataatctactagtacaaggagaaaaactacaagaagaagacaaaaaaaacctattgaaaatcatcaacgacaaaggatctataaccctacgacaaatatcaaaaaaattggaagttaatgaagacgaaataaaaggataccgtatagacaaaaaaggaaaagcactcttcactgaattcaaaggatacaagatcttaaagaaactgtttttaaattgtggacaaagcatatcactggaggattatgaaatgctagacgaaataatcgagatagtaactaaaaaaaaaggaatcgatgaaagaaaagacgcactaaaagaactcaaatgggacttaagcgacgacataattaactcattaagtgaagtaaccggcatagtaggctaccatagcctgtccttaaaagcaatacgagaactggattcagaactatacaaaacatcattaaatcaaatgcaattacttcacgaactgaaaatgttcgataaaaacagaccaagctataaaggcaaaaagaacatagttgcagaccccgaagcaatattaagcccagtcgcaaaaagagcacaaaacgaaacattcaaggttattaatgcactaagaaaaaaatatggagagttcgacagcatagtcgtagaaatgactagagataagaactcacaagaacaaaaaaaaagaatcaacgacagccaaaaagcattagaatcgctaaacaaagaagtagatcaactactccaacaaaagggctacgatccacaaaaagtcaaagggaaaacaaaacaaaaggtcagattatatatgatgcaagaaggtaaaagcgcgtatacattacaagaattggatttacacagagtgatcaaagacgacaaatataccgaaatagaccatataataccaataagcatttcattagatgacagtcaaagcaataaagtacttgccttacacagcgaaaaccaacaaaaaggaaatctaacccccttcatggcttttcataccggaagattcgcggacatgggctgcacgtggaataaatttaaagaaaatgtactatccaacaagaactacaaacataaaaaaaaaaacaacttactagatgaacgagacataaacaaattctcagtaatacaagaatttataaaccgaaacctagtcgacactagctatgcaaacagagtagtactaaacactcttacagactatttcaaagacaatgaaattgataccaaagtacatacagtaaacggaaaattaacggatttatttagaaaaagaataaacctaaaaaaagataggaacgaagactatctacaccacgcaatagacgccctgatagtcgcaagcatcaaaaaactaagactcttggacggatacctagcaaaatatggcttcgaaacactatacgacgaaatgacaggagaaataaaagaaattccagaagataaagctttttttgatgacaaatacatacgatatatattaaacctcaaaacaatctatgaaagtagcaacatgtactatagaggaatactagaaagagaagaattaatataccaacccataaaaatatcacataaaatagataccaaaccaaatcgaaaagtttcagacgaaaccatttactcgacaagaataattgacaacgaggatcacctaattgaaaaatattcagacatatacgacccaaaatttaaaaacctcacagaagatatcctaaatggagaaaagaataaatatttgatggagaaaaatgatccccaaacgttcaatatactaaaacaaataatattcaaccactacaacacttacaaggactcaaaagaatactataaaatagagaaaaagaaagaaaaagaaataataaaactagtaggaattaaccccctttctttatacaaagaagaaaacggccccattaaaaaatactctaaaaaaggtaacggaccagttatcatgtcaatgaagtacgactctgaaaaattaggcaaccatattgatataacaccagactccgcgaaaaataaaaaggttatcctcaaacaaatcagcccctatcgaacagatttttataaatgcagcgacgaaaaattcagatttgtaacagtacgctacaaagatgtacattatcaaaaatcgatagataaatactgcattgataaggaatggtatcaaaacgaaaaaaaaaacaaaaaaatagacgaaaaagcagaatttttattttccatgcatcatgacgaactaataggtatcactagaaaagaatcggaacaattcatctacgacgaatctaaagagaaccacggagacccgcgataccacgacggagtaaaacccgaaatcctaaaattcacagctaccaataatgatactaaaggaatcattgaagtcaaaccactatatacctattcagcttacagacttaaacctactgtactaaacgtgaaaaacataaaaaaatacgcaaccgacgtattaggcaacctctacgaagtaaaacaaaacgaactcaagctagagttttga

SEQ ID NO: 5083 - RNA, 3333 nt, synthetic construct
  misc_feature 1..3333: note = Cas9 variant
  source 1..3333: mol_type = other RNA
atggcagaaggtaagaaacgaatatggagacttggcgcggatttaggtgcaaattccctgggatgggcagcaatagaacttagtgcaccagtaaatggaaaaccaatcgcaatcttggcagctggctcaaggatattctcagatggacgtgatccgaaatccggagcatcattggccgttgacagaagagatgcaagagcaatgagaagaagacgagaccgattcaaacaaaggcaaaaggctttaataaagtatttaattgctgacggcttatttccagcagatgaagcagcacgaaatgctatggctgcgatagacccatacgcagttagagcacgagcactagacgaggctttatcactacccgaattggggagagctcttttccatctaaatcaacgacgaggatttaaatctaatagaaaagcagatagaaaagcggacgatgacgcaggaaagatagcaataggaatagatcgcacaagagacgcaatagcagaagatgaagcagacgcaggagcagaacctggaagctggacattcggcaagtggcttcatgagagaagactaaaaggacaaagtgttagaacaagacttcgcccagaatcaggcgaagacgccaaaggagacggctatgatttttatccagaccgtgctctcatggaagaagagttcgatgcaatctgggcagcacaagcccctcatcatccagatgtcctaacaaatgatgtccatgatagattacacgaaatcatattttatcaacgacccctcaaagcgccacaagtcggaatgtgctcgctaattcctggagatagaagactcccaaaagcccatcccttatttcaacgccgaaggttactggaagaactaaatgccctcatgatagtacgaccaggagaagttgcacaacgtctaacaagagaagaaagagacatacttttactaaaactcaaagataaaaataaagtctctttcgcaactctaaggaaagctctaaaactagatcccgatgcaagatttaataaagaaagtgaagacagaacagatttaaaaggggatgaagtagcagctgttatgggatctaaaacaagattcggaaacttatgggttcatttaagtatagaagctcaatgggatgtactagcaagactagacgcagttgaaagcgatgcggaagatgccgctttctgtgcatggttagttgaaacgtatgcgctgacaccagaacaagcaagggcagtagcaaatgcgcctttaccaccagggtacggccggttcggagaaactgcgacaagaaaattaattgaagcactaagagacggaaagaaggacgatcgagtcttagtatacagtgaagccgtcactgaagctggcttaggccatcatagcgacagaagaacaggagaagtatttgaagacgcgaaaggaaggccgcaattgccctattatggagtggcattagaacgacacataatgccagggacaggagatccaagcgacccagaagagatgcgagtcggccgactaactaatcctacagtacatattggacttaaccagttacgaagaatactcaatgtacttataagagcgtatggaccgccagcagaaattgcaatcgagctggcaagagagttaaaactaacagatgaagataagaaaagaataaacagagagaacaacgataatagaatagcagcagagagacggagcgaaaaattgctcgcaataggacaagcagactctggagcaaatcgagcattactgaaactatgggaggaactaaatccagcaaatgtactagataggagatgcatatatagtggaagacaaataagcatcgacatgcttttctcagctgctgtagaagtggaccacatacttccctttgctgcaacactagacgattccaatggaaataaaatagtttgtttacgagaagctaatagagagaaaagaaaaaggagtccacacgacgcatgggggcatagtgcacgatgggacgaaatagcagccagagcagctcaactaccaagaaataaaagatggagattcgaaccagatgcaatggataaattcagagatgaaggtggtttccaagctcgacatctcgtagacacacaatacctagcacgactaagccgagaatatttagccacgttgtatccagaaaaaggagaaggctcaggacatatttgggtatcgccaggaagactaacagaaatggtacgaagaaaattaggtttaaacgacctgttaccggatcacaactttggaggaggagcggatcaagcgaaaaacagactcgaccataggcatcacgcaattgacgccgtagtcgtagcgatagtggaccggggaatgttgaacgctatagcaagggctagtggtcaagaaggagctgaaggaagagaaagaataataattccagagccatgggacgggtttagagacgctctacgagagaccgtaaatcgcatcaccgtatcacatcgcaccgaccacggcacagcatcaaaagcaggattaccaaaaggaaaagacgcaacagcaggacgattacataatgacacagcatatggatttaccggagacacggatgcaaaaggtaatagcatcgttgtaagaagagtaccactatcaagtttcaagaaattagcggatctagatcgtatacgagatgcagatctaaaagccgcattgtatcaacatctaaacggactagaaggaaaagcgtttgaaaaagcattggctgagttccataaattggaatggcacaattttggtggcgtaagaagagtgagagtaactgagccattaacagttattccaataaaagatagaaatggaagaatctataaagggtataaaggtgactcaaattacaggtatgatgtatgggaactacctgacggcaaatgggtgaccaattggaaaaacgaagcaggggaagcaatgagtagtgtaatatccatgtttgacgcacaccaatcatcagaacccccaagaccacacccagcagcaagaaaaatattaagtctgcatcaaaatgacctattagctattgaaagagagggagaagatagaaaacttatgcgtgtagttaaattcggacaaagcgggcagattacactcgccgaacaccaacaagcaggggatctaaagaaacgagatgcagtaagcaatgatgacgacccttttaaatatttcgcaccgacaagtggaggcttgaagaaagtcaaagcgaggcaagtaagaatagacgaaataggtagagtactagacccaggctttccggcaagaactgcgagaagaaaaacgcgagggtga

SEQ ID NO: 5084 - RNA, 3333 nt, synthetic construct
  misc_feature 1..3333: note = Cas9 variant
  source 1..3333: mol_type = other RNA
atgacggcaagaactcataaaatatggcgattaggggctgatctcggagcaaacagtcttggatgggcagccatagaactatcggcacctgtagatggaaaaccaatcgcaatacttcatgcagggagccgaatattttcagacggcagagatcccaaatcgggcgcttcattagcagtagatagaagggatgcgagagctatgagacgaaggcgagaccggctccaacagagacaaagagcacttataaaatacttaattgcagatggcctctttccagctgatgaaaacgaaaggaaagcaatggcaacaatagatccatacgcagtccgcgcaagagcactcgatgaagctctaacgttgcccgaagtcgggagagcactcttccatttgaatcaaagaagaggatttaaaagtaataggaaagctgataggaaagctgatgaggacgcgggaaagattgcgattggaattgacagaacccgagatgctattcgacaagcagaagaagaagccggtgctgaaccaggctcatggacatatggtaaatggttgtatgagaggagagcgtccgcaacagacgcaaatgcaataccatcggtgagaacgagattgagaccggaaactgacgaacacgctaaaggggatggatatgatttttatcctgggagagccttaatggaagcagagtttgcagcaatatgggaagctcaagcagcacatcatccagacgcgttaacaaatgaggtacatgatagattacacgaaataattttctaccagagacctttaaaagcaccgcaaataggagtatgtacattaataagaggagatcaaagacttccgaaagcacaccccctatttcagaaaagaagactcttagaagaattaaatgcattaacaatagtaagacctggagagatggcccaacgtctgacaagagaggaacgcgacacactattcttgaaattaaaagataaagccaaggtgtcatttgtaagtctaagaaaaacactaaagctagaccctgacgcaagattcaacaaagagtcagaaaatcgatccgatttaaaaggagacgaagtagctgcagcaatgggtgccaagacgaggtttggaaatagatgggtgcatttaagtatagaggaacaatgggatgtcatagcgcgtcttgaagaagtagaatccgatgcagaagacgcagcatgtagagcatggttagccgcaacctttgatttaacaccagaacaaatcagagcagtaactaatgctccgctaccaccaggttatagcagatttggtaaagtggcaacacaaagactgattgatgcactccgggacggagaaaaagatggtagagtattagtatattctgaagctgtagcggcggcaggattaggacatcatagtgatctaagaacaggtgaaatatttgaagatgcccaaggacggccacaactcccatattatggagttgcactagaacgacatatcatgccgggcacaggaaatcccgatcatagtgacgaaatgagaattggtagacttactaaccctacagtacacataggactaaatcaattacgaagaatagttaatacattgatacgagcatatggaccgccggctgaaattgcaatagaactcgcccgtgaactaaaattgacagatgatgacaagaaacgtattaataaagaaaataatgaaaatagattagctgcggagaaaagaagtgaaaaattattgacaataggaagaccagatacaggagccaaccgagcattactgaaattatgggaagaattaaatcctgcaaacgtgttggataggcgatgcatatacacgggcacccaaataagcgttgatatgttattcagcgccgctgtcgaagtcgatcatatactacctttcaccgcaacattagacgactcgaatgggaataaaatcgtctgcatgcgagaagccaatagaacaaaacgaaaacaatcaccatatgaggcttggggtcatactgacagatgggaagaaatagcagcaagagcagcacaactacctagaaataaaagatggagattcgaacctgacgcaatggaaaaattcaaagacgaatcaggattccaagccagacatttggttgatacacaatatctagctagattatcaagagaatatttggaaacactatatcctggatcgggagaaggaagttcacatatatgggtgagccctggtagattaaccgaaatggttaggcgcaaattaggattgaatgatttactacctgatcacaactttgggggaggtgcagatcaagcgaaaaatcgtcttgatcacagacaccatgcaattgatgcagtagtagtagcgatagtggacagaagtatgttaaccgaaatttcaagagttagtggactagaaggagctgaaggtagagaacgaataatcataccaccaccatgggatgaatttagaaatgatcttagaactgcagtgaacgcaatcacagtcagtcacagaaccgatcatgggacaataagtaaagctggtttacccaagggcaaagacgccaccgccggtagacttcacaacgatacagcgtacggatttacaggtgaaacggacgcaaagggcaattccatagtagttagaagagtaccattggcttcattcaagaaactggcagatctagacagaatcagagatacagatctaaaagcagcattataccaacaccttgaaggacttgaaggtaaagcattcgaaaaagctgtgatggactttcccaacttagaatggcatccttttggaaatgtgcgtagggtacgggtaacagaggtattaagtgtaattccgatatctgaccaaaatggtagaatttataaaggatacaaaggggacagcaactatagatatgacgtctgggaattacccggaggaaaatgggaagctgaagtagtaagcactttcgatgcgcatcaaccggactgggtatcaaaaataagaagtcgtagtcctacagccagaaaagtcctatcattacaacaaaatgatcttatagcagtagaaagagcgcacgaaactagagaactaatgcgagtagtaaaatttagacaaaatggagaaattaccttcgcaccgccacaagaggcaggaagtctgaaaagaagagatgccactcccaatgaagacgacccatttaaatactttgctgttgcagcatcaagtttacaaaaagccaaagctagacaagtgagaatagatgaactgggaagagtattggatcccggatttccagcacgaacagcgagaagaaaaacaagaaaatcaacatga

SEQ ID NO: 5085 - RNA, 3333 nt, synthetic construct
  misc_feature 1..3333: note = Cas9 variant
  source 1..3333: mol_type = other RNA
atgaggatactcggattcgatataggaataacatcaataggatgggcctacgtcgaaggggaagaattaaaagactgtggagtacgaatatttacaaaagcagaaaacccacaaaatggcgactccctcgcagctcccaggagagaggcaagaggcgtgagaagaagactcgcacgaagaaaagtacgactaaatgtaataaaacggctactgtgcaaagaatttggtttgaacctaagcgattacttcgcaaacgatggagaattacctaaagcatatgaaacaactaaagataccaaatccccgtatgagcttagatctctagcgttagaacaaaaattagaaccaaaagaactagcacgtgtgattcttcatattgcaaaacatagaggatacggcaataaacatgcaaaaagggatctggaggctgaagagaaagcaaagaaagctgccgaaaaagcaccacaagaaaaagaaagtacaacaacaaatggagactcaaagaaagaacaagaaaaagtactaaaagcattatatcaaaacgaaactctcctaaagaaataccaaacaaattaccaaactaacaataaaactaacgatgagaccaacaacaaaaccatatttctagtgggaaaatacttatacaaagagttccaagataaaggacaaagaattaggaacacaaccaacaactaccaacacaccatgagacaagaatggcttaaagatgaactagagttcatcttcaagaaacaaaaagattttggagctacattcagcgaaaactttgaatcacaaatcctcgaaacagcattctaccaaagagacttaaaatcattcgaagataaagtaggaaaatgtgtattctacgaaaacgaaaatagagcgccaaaagattcactgtcggctatggaatttgtagcattaacgaggataataaacacattaaagaatctagaaaagaaaagtaaaaacttaggcataggcgaaacttatggcaaagataaaatacaagaaatactaaaaatagtattggacaaaggcgaaatgtcatacaaagaactacgaaaaatattaaaactcaacgagtcgatacttttcgcaaaagacagcaaacttgattacacgaaaggtatgcaagaggcagaaaaagctaaattcatagaattaaagaatttaaaagcattcaagaaagctatgggaggagactttagcaaattcccaagagaagaactagacaaaattgctacagacatagtactaataaaatcaaaagaaaacctagcaaagaaactacaaaactatagtgcactatcaaaagaacaagtagaagcactatcaaatctaaattttgcaaaacatatagatttaagtttaaaagccctcgacaaaatactaccctttatgagagagggcttaagttacgacgaagttgtaaagaaagtcggactccaagaacacagaaaatataaacaaaaaggcgagtttttaatcccattaaaagaatacgaaccctatctagcaaatccagtagtagcacgagcactctccgaatacaggaaagtcttaaacgcgctgttacgaaaatacggaaatgtacacaaaatacatcttgaatttaccagggaagcaggtaaaaattacgatgaaagaaagaaaatcgaaaaagaacaaagagaacacttcgaagccaatcaaaaagcgataaaacaacgcgaaatcttaggactcccaataaacggcgctaacatattgaaaatgaaactatggattgaacagggagaatgctgcgtatactcaggggagaaaataacaagcaaacacttcttcgattcaaacgccttacaggtagaccacatatacccatactccagaagttttgacgactcgtatatgaacaaagtactggtcttcgccaaagaaaatcaaaacaaactaaacaaaacaccattcgaagcatttggaagcgacaaagagaaatgggacagaattttatcgttatcagcgaaacttccgaaacagaaacaaaggagaatatcaaataaagactttaaagataaagaattagggtttatagctcgaaacatcaatgatacaggatacatagcaagactagcgagccaatggacaaacaattgcttaaaattcgaggatctaagggaaaatgaggttactatagcaggagaaaaagggagtaaaaatcatctcgaagtcatatcagggcaattaacttctatgttacgacactattggggcctcggcgataaagacagaaataaccaccttcatcatgctgtagatgcagtaatcattgcatatactaatgcaaaaacaatcaaggcttttgctgatttcaagaaaaaccaagaacaaaatagagctaaattttacgcaaaacagatatcagaacaggaatacaaaagacaacgaaaccctttcgaaccttgcgcaaacttcagacaacgagtagaagagaaaataaataaaatctttgtcagcaagccaccacgaaaacgagcacgaggagcattacataaagaaacattcggtagcatctgcttagacggcaataataactgggtagcgagatttaagatcaaaagtaagaaagaacaagaagatattacaaaagaaaaagctacgaaagcgaaatacaaagacgagttcaaaggagaagaaaacatacgaaaagcgctaaaacttggaaaaatcaggagaattaacaacacccaaaaagatattgcaattggagacaaaatagtcaaaaacgaaacgatggtaagagtagacattttcaaagacaagaaaggaaaattctatgcagtacctatctatacgatggattttgcactaggcatcctcccaaacaaagcagtagcaacaggagaagatgaagatggtgtaataaaagactggatcgaaatggacaaaactaaatacgaattttgtttctcattatttaaagacgacctgatcaaagtacgtaaaaagaaaatgaaagaagcagaactatgctatttcgttggatttgatacagacggttcaagaataattgtggcgaaacacaacaatgattatcaaacaatgacggaaaatgaatgcaaactattcacactaaaagaaaagaaaaagaaacagaaaacattaaacgacgaagaagataaccaagaaagaatagaaaccgaatacaaaataataggaggaagaacaggaatacagaaccttgaaacattcgaaaaacaccaagtatcaccactaggagaagtccaaaaagcagagttcgaagatagacaggaaataaaattgaaatcctctccaaaaggcaaagattga

SEQ ID NO: 5086 - RNA, 3333 nt, synthetic construct
  misc_feature 1..3333: note = Cas9 variant
  source 1..3333: mol_type = other RNA
atgtcagagaaatatcgcttaggactagatgttgggacaaactctctaggatgggcagtaataggactaaaggaagacgtaccctcttcagtattagcaacaggggtaagaatatttagtgaaggaagagacgccaaaacgaagtcaactttaaaagctagtcgaacagagaaacgttcagcaagaagacgacgagatcgttttctacaaaggcaaacatttttaatatccgaaatggtaaagtcagggttgttccccaaagatatagtagaacaaaagaacctagaattattggatccatatgaaatcagatttaaagccttaacagaacaagtaccgcttcaccacctaggtagagcactgttccacataaaccaaaggcgtggttttaaaagctcaagaaaagataaaagtgaagaaacaacatcaggtgtagtaagtaagtcagtcagagccttatatgaagaaatgcaactgataaatccagcgccagttatagatgatcctaaagccttgagtaaagaagaacgtagagaaataagagtacaagaagcatccagtcgtgaagaagcattagtaaccctagcagaacaaaaaggtgtaacctttggtgcatttctatacagaagattacaaagcggtaaaagcgttcgagctcgtaaagatgcagattcacaactttatgatgtataccccacacgagaacttctcaaagacgaatatagcaaattaatgcaacatcaggcccagtactaccctaatgtaattaacgaagcactaatatcaagactacacgacgtaattttctttcaaagaaagttaaaagaacaagaaagaggtttctgtacatactacccttctgaaagacgaacctttagatgtatgccatcgttccaacaataccgaatggtacaagaactaaatgcattagaatgggtcgatgcggccggaaagcattgtttacgagactaccccgaatctagagacttaatactatctgaattagaaaatataagtacaaaagcaggagagttcacattcggtaacatgaagaaaatattaaagaaaatgggtgtaatagacggagaagttagcttcaattttgagggacccaaaagaaaaggattccagggaaacgtaacatctcgcgaaatgcgacatgaagactgcttcggtactagatgggatgaactatcactagatgaaaaagacgacatcattgacaaaataaatgatgatcacttggatgacgaagatatggaaaggtatctcatagacacatatggactatcatcatttagtgtaggaaatgctataaacgcccgcctcctcgaaggaacagcaaacgtgtcaaggaaagccgcaagaacattatatgaaacaatgctctcggcgaattgtcttcaatcagatgcagtcatagcagtatcagaacaagatgatacatttgtaaatccatatagcagaacaggcagaggtgaactactaagtgagttaccatactatggagaagcatttcaagatggtagacatataataccaggtaaaagagaaccaaaggtctcacatgatcaactaaaattctatggaggtgttagtaatcctactgttcatatagctctaaatcaaataagattagtagtaaacgaaatcatcaaacgttatggtctaccgtcatctattagtattgagcttgctagaaatttaccagaaggacaggatggacggcggaaaatagagaaaatgcaaagcgaaaatcagaaaaacaatgaaagatacgaccaaattttaacagaaaacggacaaagccctaatcgggacaatcggctacgactcgccctatgggaagaattaggcgaaggtccaactgacagattatgcgtatttacaggaaaacttatagaattagcagacttatttaacggttctgtagaaatagaacatttaataccatttagtgttagtctcgatgattcaaaagcaaataaaacagtctgttggaaagaagcaaatagatttaaaggaaacaagaccccatatgaggcatttgcaaataacagcggagattattcatgggaagagataatggaaagagtaagagcattacccaattcaaaacaatggagatttcaagaggatgcactaaaaatttggaactcagatcattcagatttttctggacgacacttaaatgacactaggtatataagccgactggcaagagaatatctcgaaaatatttgtccattcaataagatagacgtcgttacaggaagattaacagcactattacgaggacattggggtcttaataatatactacggggtcataacgaaccggaaacagctacacctaagaaaatgagagatgatcataggcaccatgctatagatgctgtagtaatagcaatgacatcattaacgatattacaaaaagttagcagcgctgcaggcaaagcagaggaactcgatgtaggaaaattattcgcaaaagatgaaagtggaagaagcgtaatagacccatgggatggcttcagagacgaggtggctgaaaaagttcggaatataatagttagccataaaaccaaaagaaaaactataggcaatagcggaaaatcaacagatagagcgctacacaacgaaacggcttatggtttgatagacggaccggacgagaagggactatacagcgtagttaccacaaaaccaatttcctactttgataatagagacaaaatagaaaagataagagatgaaaaattaagagacgatttcttaaccgcatgggatggagaaggtgacaataaagcctctcaattagctgtattagacaaagcaagcggtctaaatgtaaagaaatgtcgatatgtcgaaagaaagaaagttatccccattaatggacccgatggacaaccatacaaagcctatgacggaaatagtaattggggtatggaaatttatgagttcccaaatggacatcctaaagaaaagaaatggaacggagtagttattagcacgtacgatgctaataaatcagaatttaaaccaggagaaacattcagaccacacccagcagcaaaattagtaatgagactacatattaatgatatagtagaggtacaaaacgacggagaacctatattatatcgagtacaattaatatcggcaggaacactcacggtttccccattacatgaagctaacgtagatagcagaaatcgagacaaacacgacgaatttaaatacaaatcattgtccgttaccccgatgcagaaaatgggagcgaagaaagtaaatatatcaccaacaggacttaaaaactattccaggtga

SEQ ID NO: 5087 - RNA, 3345 nt, synthetic construct
  misc_feature 1..3345: note = Cas9 variant
  source 1..3345: mol_type = other RNA
atgggtataataataggactagacatagggatcgctagtgtaggaattgcagtagtggacaaagacaccctagatataaaatgcgtcgtaagtgacttgttcgattcagcggatgctagcaaaaatatagaaagaagaaacaatagacaagccagaagattaaatagaagacgaaaaactagaattggagattttaataccctatgggtatcaatgtttggagagctcccagaagaagttgattcaaatgtcttactactaagaaatgcaggactagacgaacaactaacactagatgaaatatattgcgtcctcaagtatatgctaaaacacaggggaatatcatacctggaagatgctcttaatgaagaaaacgtaacaggaagttaccagaaagggattgcaataaaccagagagaatccgagtacatgctaccttgcgaaatacaactagaaagattccgaaaatatggacaatacagaggagaatgcgaggcagaaaacgaaaacggtgaaaagataaccctaagcaacgtatttatgactaattcatacagaaaggaaatagataaattcttaaatacacaaggaaaatacggaatactaaaccaaaaattcatagacgaatacctaaaaatattcaatcggaaaagaaaatactatgaaggacctggtaatgaaaaatcaagaaccgactacggaaaatacacaacaggaaaagatctagatggaaaatacataacggaaaaaaacatattcgaaaaattgataggcaaatgctccgtatacaaagaagaattacgtgcagccggagcgtcctacacagcacaagaatttaatattctaaatgatctaaacaacataacagtcaacaacaaaaaactaacaactcaacaaaaaaaagacgtcattgaaatagtacaaaactctgaccgcattaacatggaaaaaatcataagcagctgcataggagaaaaaatcgaaaaaatagaaggagcccgaatagataagaacgaaaaaaatatataccacacctttgaacaatataacaaaatgaggaagatcttcgcggaaaaaaactatgacataaaagaactcacaattgaacaacttgacgagattggtagaatactcacaattaacacagagagagaagggattaaggatgcaatcatggaatcagaactactacacctcaataacgaacaaatcaaccttctcatagaactaaggtacaaaaattcatcactcttcacaaaatggcaaagcctgtcaattaaagcaatgagagaaataatacctgacctctatgatagaaatgtgaaccaaatgaatatacttgccgagagaggagtatttaaggacaaaattaatctgttcgaaaactccgtatatctaccaaaagagccagtactagaagaaatatataaccccgtggttcgaagatcaatatctatgaccatagacgcattgaacgcactaataaaaaaatacggataccctgaagatatcgtaatcgaaatgccaagggacagaaatgacgcagaacaaaaagacagaataaaaaaattccaaaaaacaagagaaaacgaactaaaaaacataaagaaaaaaataaaagaagaatatggcatagaaataacagacgaatacttccgcaaacacaaaggattagaactagaactaaaactgtgggtagaacaaaacgaaaaatgtccatactcaggaaaatacataaacgtacaagatatactctaccaccatgagctctttgaaattgaccacattatacccctctctatatcatacgacgactcaagaaataataaagtactagtatataaagaagaaaaccaagacaaaggaaatcgaacacctctaatgtacctatccacggtaaacaggcaatacgaccagcatgaattcatgaactacgtgttatccacaaaaacactaccacgcaaaaaacgagaattattattaaactacgaagacataacaaaaatagatgtacttaaaggatttataaatagaaatctaaacgacacgagatacgcctcaagaagtgttttaaatgcaattcagctgttctttggaggcaaagaatgtgacacaaaagtaagagtaatcaggggagccgttacaaaccaactaagaataaaactaaatctaccaaaggaccgcgaaaaaagctactctcatcacgctatagatgccgcaattatgtgttattcgcaaatgggcttaatgaacttcagaaacatccaaaacaaattcatagatttcgaaaacgaaacatacttaagtgacgaacgcgactcgtgcttcgataacaaatactacgacgaagcactatttggacaagtgttaaaaatgaggaaaaacttattaaaagcagagggtaaaccacaaagaagtgtacaatcaaaaggagtattcgacgaagaagaaaaaaacaacggaattgtacgttatcatcataaagtggacaaaaaaccaaataggggtctctctaatgcgtcaatatacggaacccgcaaaattgacgacaaaatatataaaatagtaggatatgacataagaaataacaaagacgcagaagcaatcatcaatattataaaaaaagggaaaagcgataatttcttgatggcaaaacacgacccagaaacatttaaaaatttaatggaaatttatgagcaatacaaagaagaaaaaaatccttttttggcatacgaacaggaaaccggagattacataagaaaatatgctaaaaaccataatggcccaataattaaaaaaattaagtacgtcgattccgaggtaggatcatgtatcgacataagcgcaaactacggttataaaaatggagataaaagagtcataatggatacactaacaccatacagggcagacgtttattacaactacaaagatggaacctaccgaataataggagtaaaatatgcggactttaaatacagtaacgcaaaatacgtactcgatgaagaagcttacgccctaatactaataaaagagggattacttaagataggcgatagtcttgaaaacatatcaagctctggatatgaatacagactaagcttctataaaaacgacataatcgaatataccaaaaacgatatagtatataaagaaagattcttaagtcgaacaatgccaaaagtaaaaaactatatcgaaacaaaacccatttcagcggcattatacgaaaaaagaaacccaatcggactaaccaacgctacgaatatatgtaaaatttacacagacgtcctcggaaatgaaacaaagatctacaaagaaaaattcaaactttcagtcgattga

SEQ ID NO: 5088 - RNA, 3345 nt, synthetic construct
  misc_feature 1..3345: note = Cas9 variant
  source 1..3345: mol_type = other RNA
atgaattatacagaaaaagaaaaattgttcatgaaatatatattggcactagatataggaatagcttcagtcggctgggcaatattagacaaagaatctgaaacagtaatagaagcagggagcaatattttcccagaagcgtcagcagcagacaatcaattacgtcgagacatgagaggagcaaaaagaaataaccgcagattaaaaacaagaataaatgacttcatcaaactatgggaaaataataatttatcaataccccaattcaaatcaacagaaatagtaggattaaaagtcagggcaattacagaagaaataacgctcgacgagctatacttaatactatacagctacctaaaacatagagggatcagctatttagaagacgcgctagacgacacagtatcaggttctagcgcatacgccaatggtttaaaactaaatgctaaagaactagaaacacactacccttgcgaaatacagcaagagaggctaaacacaataggaaaatacagaggacaatcacaaataataaacgaaaatggagaagtacttgacttaagcaatgtcttcacaatcggagcctacaggaaagaaatccaaagagtattcgaaatacaaaagaaataccacccagagcttacagacgagttctgtgatggttatatgctcatattcaaccgaaaaaggaaatactacgaaggccctggaaacgagaaaagccgaacagattatggacgatttacgaccaaattagacgcaaatggaaattatataacggaagacaatatatttgaaaaattaattggaaaatgcagtgtataccctgacgaactccgagcagccgctgcatcttacacagcccaggaatacaacgtactgaatgatctaaataaccttactataaacggcagaaaacttgaagaaaatgaaaaacacgaaattgtagaacgcataaaatcaagcaataccataaacatgagaaaaataatatcggactgtatgggcgaaaacatagacgactttgctggcgcacgtatcgacaaatcaggtaaagaaatatttcataaatttgaagtctataataagatgaggaaagcattattagaaataggaatagatataagtaactactcaagagaagaattagatgaaatcggatatataatgacaataaatacagacaaagaagccatgatggaagccttccagaaatcttggatagacctatccgacgatgtaaagcaatgcttaataaacatgagaaaaacaaatggagctctcttcaacaaatggcagagcttttcactaaaaattatgaatgaactaatacctgaaatgtacgcacaacctaaagaacagatgacattactcacagaaatgggagtaacaaaaggcactcaagaagagttcgcaggcctaaaatacataccagtagatgtagtcagtgaagacatctttaatccagtggttaggagatcagtaagaataagttttaaaatattaaacgcagttctaaagaaatataaagcactagatacaattgtcatagaaatgccaagagatagaaacagcgaagaacagaagaaacggataaacgacagtcaaaaactaaacgaaaaagaaatggaatacatagaaaagaaactagcagtaacatatggaataaaattatctcccagcgacttttccagtcaaaaacaactaagtctaaaactaaaactctggaatgaacaagatggaatatgcttatatagtggtaaaacaattgaccctaacgacataataaacaacccacaactcttcgaaatagaccacataataccccgatcaataagttttgacgatgcaagaagcaacaaagtgctagtatacagaagtgaaaatcaaaagaaaggaaaccaaacaccatactactacttaacacattcacattccgaatggtcattcgaacaatataaagctacagtaatgaacctaagcaaaaagaaagaatacgctatatccagaaagaaaatacaaaatctactatactcggaagacataacaaaaatggatgtactgaaaggtttcataaacagaaacataaacgacacaagttacgcatcaagactcgtactaaatacaatacaaaactttttcatggctaatgaagccgacaccaaagtaaaagtaataaaaggatcatacactcaccaaatgcgctgcaacctaaaactggacaaaaaccgtgacgaaagttacagccaccacgcagtagacgcaatgctcataggctatagcgaattaggctatgaagcataccacaaattacaaggagaatttatagacttcgaaacaggggaaatcttgcgaaaagatatgtgggatgaaaacatgtcagacgaggtgtatgccgactacctatatgggaagaaatgggcaaacatcagaaatgaagtagtaaaagcagagaaaaatgtcaaatattggcactatgtcatgaggaaatcaaatcgaggattatgcaatcagacgataagaggaacaagagaatatgacggaaaacaatacaaaataaataaactagacataagaactaaagaagggattaaagtcttcgctaaattagcatttagcaagaaagactcagacagagaaagactccttgtttacttgaacgatcgccgcacattcgacgacctgtgtaaaatttacgaagactacagcgatgcagctaatccattcgtacaatatgaaaaagaaacaggagatataatcagaaaatacagcaagaaacataatggtccgagaatagacaaattaaaatacaaagatggagaagtaggtgcctgcatagatatcagccataaatatggatttgaaaaaggttcaaagaaagttattcttgaaagcctcgtaccttatcgaatggatgtctactataaagaagaaaaccatagttactatttagtcggcgtaaaacaatcagatattaaattcgaaaaaggacgaaatgtaatcgacgaggaagcctacgcaagaatcctagtaaatgagaaaatgatccaacctggtcaatccagggcagatttggaaaacttaggatttaaatttaaattaagtttctataaaaacgacataatagaatacgaaaaagatggaaaaatatacacagaacgtctggtatcaaggacaatgccaaaacagagaaattacatagaaactaaaccgattgacaaagctaaatttgaaaaacaaaatttagttggccttggtaaaactaaattcataaagaaatacagatatgacatactcggtaacaaatactcttgctcagaagaaaagttcacatcattctgttga

SEQ ID NO: 5089 - RNA, 3348 nt, synthetic construct
  misc_feature 1..3348: note = Cas9 variant
  source 1..3348: mol_type = other RNA
atgagcgccacatatacaattggcctggatataggaatagcaagtgtaggctggtgcgcattcggggaaacacacatcctagatctcggtgtaagggcgtttgacaaggcagaaactgctaaggaaggagaaagtttaaacttagcacgaagaaatgccaggctcatgagacgtagactatttcgacgtacgtggcggttaaagaaattagcaagacaattaaaaagtgaaggtttaattgctgatacaaaattgttcaaaccagaattaccattctcaaagtcattatggcaattgagagtagatgggttagaccgaagattaaacgatgaagaatgggctagagttatctaccatttatgcaaacatagaggatttcattggatatcgagagccgaagcaaaacaagcagaaggagattccaaatcagaaggcggaaaagttaaacaaggcctagcgggcaccgctaaattgatggacgaaaaaggatatagaagcgcagccgaaatggtactcgccgaatttcctcaagcacaacggaataaacaaggcgaataccaaaaagccttgagtcgagagctcctagctaaagaacttgcgctgctttttgcacaacaaagagaatatggtaatcttcataccccgggagctctagaaacagctatcctaggtaatggtgataagaaatcagggttattctggcaacaaaaaccagcattagctggcacagatctcctcaaaatgttaggaacatgtacatttgagaaaggagaatacagagcccccaaagcatcttttacagcagaacgacatgtatggttaactaggttaaacaatttgcgaattgtcacagacggtgtaaccagacaactaacagaacaggagcgacaactatgtttaccactaccatatagacaggctggagacctcacatataaacaattgggaagcgcgcttgctaaagctggtcttttagaggcaggcggttttaaatttacaggtctagcatatccaaccgaagcacaaaaagctgaaggcaaagcaaaagatcccgaatccgccactttagtaaaaataccagcatggcacgaattaagacaaacacttacaaaaggtggcttaaatgacgaatgggaaaaattagcgggtgatgccctatgcggacaaccagagattttcgataaaattgcatgggtcttaagtgtctataaagatgatgacgaagttagagccgaattagccaagctggctctccctaatccacaagcattaaccgaagcgctattaaatataagatttgacaaatttcacagtttatcgttaaaggctttaagagcaatagtcccacatatggaacaaggattacgatatgatgaagcatgtgtgcaagcaggttatcaccacagtcaactattaaaagttggagaaggagaacacaaatatctaccgccattatacgatggaagagatggcgatggacgcatgatattcgcagaagatgcagatatacccaggaatcctgtggtcctacgttctctaaaccaagctagaaaagtcgtaaacgcaattattcgacgatacggcagtccaagtgcagttcacatagaaatggcaagagatttatctagaccattcgatgaacgaaacaaaatcaagaaagatcaagatgaatatcaagcacgaaatcaaagagatcgagaacaattcagcgaactattcggacaccctccaaaaggtcttgaatttgaaaaatggcgattatacagagaacaaaatggacaatgtgcatactctcaaagacctttaacagcatccggaaacgtagcggaaattttccttgatggtagcacagagatagatcatgcattaccctactcacgttctttcgacgacagtaaaaacaacaaagttctagtgctaacgagagaaaacagagataaagggaatagaacaccatacgaatatttgggtggagctgaaaactcagaatcttggcaaagatttgtatccttcgtagagagcaataaagcatataggctagccaaaagaacaagactactaagaaaagatttcggagcaaaagaaagcgaagaatttagagaaagaaatttaaatgatacacgatatgtgtgcagattcttcaaaaattatgtagagcagcacctaaaattggcagaaggaagtgaaacaaaaagatgtgtcgtagtatcaggacaactaactaatttccttcgagccagatggggcttacttaaagtacgctcagacagtgatagacaccacgccttagatgctgcagtcgtagcggcttgtagtcatagtatggttcaaagattgagtaactattctaggacacgtgaattagaacaggtaagagacggattcgtagatatagaaaccggggaaatagtaaacccagcaatgcaccaacagttacgtgagcattttccagatccatggccttatttccgacatgaattagaagctaggctaaaaatagatagtcccgaattactacgtgaagaaatggctagactaggatcatatagcgaagaagaactaaaagttttaaaaccactatttgtcagcagggctcctcaaagaaggaatgggggtgcagctcataaagacacaatctacggacaaccagaaaaattaaagaaaaatggaagcgtaactcaaaaagtagcgctaacttcattgaccctcaaagatattgatctgttagcagatccacacaggaatgcgaaactttacggcgctatccgtgaaagactagaagcacatggaggaaaaggcgataaagcattcccagctacaaacccgctccgaaaacctgacaaagaaggaaatcccacagggccgatagtcagaacagtaacaaaagtaattgataaactaagtgggattccagtaagaggaggtatagctaaaaatgatacaatgctaagagttgacgtattcacaaaaggaggtaaattccatcttgtaccagtgtatgtccaccacagagtaacaggattgccaaatagagcaataatagcattcaaagatgaagatgaatggacacttatcgatgatagttttgactggtgtttcagcctatatccaaatgatctgctacgtataaaacttaaaaaggaaagtcactcaggttactattcatcatgcaataggtcaaccggagctgtgaacctatgggctcacgataggaacgttaatgtaggtaaggatggattcatagaatcaataggtgtaaaaatggcggtgtccatagaaaaattacatgtggatactttaggtaacatctatccagcaccaccagagaaaagaagaggactagcatga

SEQ ID NO: 5090 - RNA, 3351 nt, synthetic construct
  misc_feature 1..3351: note = Cas9 variant
  source 1..3351: mol_type = other RNA
atgtcacaaaatcaaaacccaaacacacaatcacatttaaaccctacaacacaatccagtacccaaagtaacccacaaccaacaacacaagaaagtctaaaaatcttgggattcgacataggcgtagcgtctatagggtgggcatttgttgaaggtggagaattaaaagattgcggcgttaggattttcacaaaagccgagaatcctaaagatggaagcagcctagcactgccacggcgcgaggctagaggagtaagacgtagattagcaaggcgaaaaggaagactaaatgcattaaaagtactaatctgtaaagaatttggtttaaatcgatctgattatctagcaacagcaggcgaactaccgaaagcatacgccacatctaaagaaacaaaatctccgtaccaactaagggcagaatccctagaaagaaaattaagcgctgacgaatttgctagagtaatattacatatcgccaaacatagaggttatggaaacaaacatgctaaagagtcaagcgatgatgactcaggaaaagtaaagaaagcaatttcagaaaatcaaaaagtcatgtccgaaaaaggttacaccacagcgggccaatatttatatggtgagttctaccaaaaagctagaaacttcagtgaagccgaaccaaaaagcccgaaaaacgctaggggaacccaagagttcaaaaatgtacgaaacaaaagtgaaaactacgccagatgtttagctcaaagtgaattgcaaaaagaactagaaataatattcgcaaaacaacgcgaatttggatttcaatttagtgacaagaaacacaaaactataaacgcaaacggaaaattgaaagaactagacttcgcagatgcagttttagaaatagcatttttacaaagaccgctcaaatcatttgccgataaagtcggaaaatgcactttctatgaagacaaaccccgagcacctaaagacagtctatcggctatagaatttgtcgcactaaccagaattataaatacattagctaacataactaaacgaagtggagaagtatatagtgcagataaagtgagagaaatacttagcatagtgctcgataaaggtgaaattacatacaaaaatctcaggaaagtaatagccctagatgaaagattacaattccccaaagacagcaaattagattatgcaaaggaagatgccgaaaaagctaaagccatagagttctcaaaattaaaagccttcagaaaagccctcggagggtcgttcgaaggatttattagggcagaattagacagcatagcaacagatatcgcattaattaaatccaaagacgaattaaaagctaaattagcaaattatcaatcgttaaatgatgaacaaagggaaaagctaagcgaacttagctttgataaatttatagacctgagttttaaagccttagaagcaatactccccttaatgaggggtgataaggatgataaaatatacagatatgacgaagcatggagagaagctggattagttgaagtggccaagaaaacccaaaaaggggattcattgccaccgctaatagaatacgaaaaagacttggcaaatccagtagtagcaagagcactagcagaatacagaaaagtacttaatgccttactaaagaaacatggaaaagttcacaaaattcatcttgagttcaccaggcaggcaggagtatcttctaaagaaagaggagaaataatcgcggaacaaaacaaacgattaaaagcaaatgaagaagcaagaaaaagatgcgaagaatacggactcatcccatcaggtaaaaacatactaaaactaaaactatggcaagaacaaggcgaattttgcgtatacagcggtaagaaaataacccaaagtgacctcagagatgaatcaacattacaaatagaccacatatacccatacagtaggagttatgatgattcgcaaaacaacaaagtgctagtattcactgatgcaaatcaaaacaaactcaatcaaacaccttacgaggcttttggtaaagatatatcaaaatggaaccaaatcttagggagaatagaaaaattaccaaaagcaaagaaaaatagaatcacaaataaaaattttgcaaacaaagaagcgggctttattgccagaaatattgtagatacaagttacattgctaggcttagcgcaagttataccgacgcatttattgagttttgccccctcgcagaaaatgaagacactaccctaggaagaggcgaaaaaggttccaagaaacatatcagcgtggtcaatggttcattaacagcgaccatgagacactactggggcctaaacacattattggacggagaaaatagtgaatcaaaagatcgaagtaatcacttacaccacgctctagacgctattatcatagcatacgtgaacgattcagtaatcaaagcctttagcgatttcaagaaaacacaggaacaaaataaagcaaggctcatagcaaaagaaattgaaagtgctgaatataaaatctcacgacgattcttttcaccaagtgggttcgaaaacaacgaggcatttagacaagcaataaaaagaaaaattctaggacaaagtctagagtcacgagagaacgacatgacaattaactcggaggcattaggcgagaaagtaggaggaatatttgtttcaaaaccaccaagaaaacgtgctagaggcgctctacacaaagagacatttagttcaatagacgacaaagatctacttaaaacatatggaggaaaagagggcgtgaaccgcgctataaaattaggaaaagtaagacaaatagggtcgaaaatagctgacaacggaacaatggttagagtagatattttcagacacaaagtctcgggcaaattctacggagtaccaatctacacaatggattttgcacttggcattctaccaaacaaagcagtagtaggaggaaaagataaatcaggtgtaatcaaagactggctccctatggactcaaactacgaattttgcttctcattgtttaaagacgatcttatcctcgtccaaaagaaagaaatgtccaaagcagaactatgttatttcgctggtttcgatacaagtggaggacaaattaaagtagaaaaacatgataaccattttgctacactaactgataaccaaaggctactattcaatatagcaacaccaaaagaagttgcaggaaaaagtatcggaatacaaaacttaaaagtatttgaaaaatggcaagtctcaccactaggcgaagtttccaaagctgaatttaaagaaagagaacctatcgcactaaaaagtaccccaaaaagatttttacaaggatga

SEQ ID NO: 5091 - RNA, 3354 nt, synthetic construct
  misc_feature 1..3354: note = Cas9 variant
  source 1..3354: mol_type = other RNA
atgaaacacatattaggacttgatttaggaagcaactcaattggatgggcattcgtacaacaagattttgaaaataaacaaggtaaaataatagcaactggatcacgtataataccaatggatcaaggtattctaggtgacttcgaacgaggcaatacagtaagccaaacagccgaacgaaccacatatagaagtatgaggcgacttagagaaagacacctcttacgccgagaaagactacatagagtacttcacctattaggctttctcccaccacactatgacgcccaaatcgatttcacaaaaagatacggaaaatttatagataatgccgaaccaaaaatcgcatataataatggaaatttcatatttatgaattcctttaacgaaatggtagaagactttaaaaaacaccagccgcagctattttataaaaaatcaaacggcgaagaatcaagaataccttacgactggactatatattatttaagaaaaaaagcactaagtcaaaaaataacacaacaagaattagcatggctaatactccactttaaccaaaaacgcggatattatcaactacgaggagaggaagaaacagaaaacccgaataaagaagtagcttttcatagtcttaaagtagtagatgtcgaagccgaagcaccaaataaaaaaggagaaatatggtatacaataagattagaaaacggttggatctatagacggacaagcaaaaatccattagatgattggaagggaaaaacaagagatttcatagtaacaacagacctcaacgatgatggtacaataaaattagacaaagaaggaaaagaaaaaagaagcttcagggcaccagatgaaaacgactggaacctactaaaaaaaaaaaccgaacatgacatcgacttctcaggcaaaccagtcggaacatacatttatgatcaccttttacagaacccgaatcagaaaatcaaaggaaaattagtccgaacaattgaaagaaaatactataaagatgaacttaaagcaatacttgccaaacaaatagcgctccaaccagaattattcacagaaaccctcttagctgactgcattcgagaactatacagaaaaaacgagacccaacaacaaaatttactcagcaaagactttttgcatctatttgtagaagatatcatattttaccaacgtccactttgcagcaaaaagtcaactattgcaaactgtacactggaaaaacggagttacatagataaagaaaccaacgaaagaaaagacgcaccaataaaagtatgcgctaaatcaaatccttactaccaagaattccgtgtacttcaatggttacaaaatctgagaatatatgaaatcgaaacagacagagaagtaacagcagagtttatcgagacacctcaagactacgaagccctattcaacttcttaatgtctcaaaaagaaatcgataatgaaggattattaaagtattttctattcgcaaagaacccacaaattaaagataaagccgcaaaaagtgaattaaaaaaatggcttacaacctatagatggaactatgtgtacgatgcagctgataactcctcgaaaaaataccccatgaacgaaactggatatgaacttcaacgatacttacaaaaagtagaaggcctccccgcaaacttcttaacttttgacatcacttatcaactctggcatctactatactctgtaaaagacaaagtagaattcgaaaaagctcttaaaaagttcgctaaaaaaaaacaattggataaaacatctttcgtcgacagctttaaaaatttcaaaccttatcccaatgaatacggatctttctcagaaaaggcgataaaaaaactcttgcctctcatgcgatttggaaatcactgggactttaatcgaatagatgtaagtactcaaaagagaatagacgacctaattaacggcgtagcaaacgaagatattcgaacgatcatacgcgaaaaagccgaaaaataccaattaaattctgaaacctgtttccaagacttaccactctggctagcacaatacgtagtctacaaccgacatgccgaagctaccgacatagaaaaatggacatctgtctcagaccttgaagcatacctggaagatttcaaacaacatagtcttagaaacccgatagttgaacaagttgtaacagaaacactacgggtcgttcgtgatatatggcaacagtattcgggaggtcaagcaaatttttttgacgaaatacacatcgaacttggacgagagctgaagaagacagcagaagaacggaaacaattgtcagacaagaatcaagaaaacgaaaacacaaacctaaggataaaaaagttgctggccgaactaaaagaagatgcatctatccaaaacgtaaggccatactcattggtgcaacaggaactattgaaaatatacgaagaaggagtattttcatccacggatgaaatagaagaagacattcagaaaataagaaagaaagtcgaacctacaccacccgaaatacaacgatataaattatggttagaacaaaaatataaaagtccatatacaggagaagtaataagcctaactaaactattcactgaagaatacgaaattgaacacataataccacagtcacgatactatgatgacagtctctccaacaaagtaatatgtgaaagcgctgtcaataaattaaaaacgaaccagctaggattagaatttatacaaaaccaccacggagaaaaagtacgaataacagctaacaaagaggtcaccatattcacagaagagcaatacaaagaattcgtaaaaaagcactatgcgaacaattctgctaaacaacaaaaactactcctaaacgaaattccagaaaagatggttgcgagacaactaaatgacacacgatacatctccaaatgcatttccgaaatcttatctaaaatcgtacgtagcgatgaaaaagatgaaggagttaacagtaagaacatcataccttgtacaggaaaaattactactgcacttaagcaagattggggactaaatgatgtatggaacgaactaatactaccgaggtttgaacgaatgaatcaacttacacaaacacaattgtttacaagttacaatgacaggcttcaaaaaaacctccccactgtaccaattgaatacagccaaggatttcaaaaaaaaagaattgatcacagacatcatgccatggacgcattagtcatcgcatgcgcaacaagagaacacataaactacatgaataatcaacatgccctcgacaaaagtaaagacaaaaaagaaaagcaacaaagtcgaatcgacctccatcctttatga

SEQ ID NO: 5092 - RNA, 3354 nt, synthetic construct
  misc_feature 1..3354: note = Cas9 variant
  source 1..3354: mol_type = other RNA
atgcaaactaaaaatttgttgtacacattagggttagatataggtatagcaagtgtcggttggtgtgtattaggagaaaataggattatcgacttgggagtaagatgttttgacaaagccgaaacaccagacagaggagaatcattaaataaagttagaagagacgcaaggctaatgcgtcgaagactaaggagacgagcctggagactaacaaaattagccagactactaaaacacgcaggccttattgattccactcgaatagtaagagatcggcatgatggggccgtctctccatggcaattaagagttgaaggacttgaccgaaaattagcaccagaagaatgggcaagagtcatctaccatatagtcaaacatagaggatttcactggatttcaagagctgaggaaagaaaggcagagtcagataaaggagaagggggaaaagtaaaacaaggactaagcgcaactaaacaactcatggtagagaaaaattacaggtccgcagctgaaatggtactaacagagttcccaggagcacaaagaaataaaagaggggaatatactaaagctctcagtagaatactacttgcagctgaacttaccacattgttcgaaagacaacaagagcttggcaacccgcatgcaggaccagacttacaaaccaaaatattaggcaatggagatagaaaaagtggtcttttatggatgcaaaagcccccgctcagcggctctgcattgcttaaaatgcttggaaagtgtactttcgaacgagaagaatatagagcacccaaagcatcttttacggctgaaagacacgtttggctaacaaaattaaataatttacgagtattagtagacggcgtaacgagaccattatcagatcctgagaggaggctcgcgttaagtttaccatatcagcaagcaagtgactttacatataaacaactaagagcagctctatgcaaaaatgggctactcccagattcttttcaattttcgggactggcttacccaacaggtgcccaacagccagatggcaaagctaaaaatccagagaacgaccgattagtcaaactaccggcatggcaggagttccgaaaaacgctaagagacgcaggactagaaacagaatgggaatcaatagcgggaatggcagccggtgggcaaccagatttattagatcaaataggctgggtactttccgtttttaaagatggagacgaagtactacgtgaactaagaaaaataccactaccaggaggagagaaaatggtacaggccctgagtggagtgtcattcgatacttttcacaatctcagtctgaaagcattacgaaagattgttccacatatggaagcaggattaaggtatgatgaagcatgtctcgcagccggatatcaccacagcgatctaagaaaagataccgatgaaagaagtttatacttaccacccctatattctggacgtacaacagatggaaggatggtattcagagatgatatagatgtaccgagaaatccggttgtattgcgcgcgataaatcaagcaaggactgttgttaatagtgtagtacgtagatatgggtctccaagttccatgcatatcgaaatggctcgagacttaagtcgtccatgggacgaacgaaacaaagtaaaaagagcacaggaagaatatagagacagaaatgaaaaacttaaaatagacttcgcagcagagtacggtatagaaccaaaaagcagagaatttgaaaaattcttactataccgtgaacaaggaggaaaatgtgcatacagtctgaaaccactcgatcttgacagagtcttaagagatctcggatatgcagaagtggatcatgcactgccatacagcagaagttttgatgatagtaaaaataataaagtcttagttctggcggaagaaaatagaaacaaaggaaataggacaccatatgaatatttggatggaacctcagaaagcccaagatggagagaatttaaagcatttgttgaaacaaataaagcataccgactagcaaaaagagctcgtttattacgaaaagatttttcaggaaaaggaagcgaagaatttcgtgatcgaaaccttaatgacaccagatatatatcaaggttctttaaaaactatgtagaaagatttcttaagttagcagaggaatccgaagaaagaacctgtgtagtgctaagcggacaattaacagcctttctaagagcgagatggggattagcaaaagtaagaggcgactcagatagacatcatgccttggatgcggcagttattgcagcttgttcaagaagcatggtgaaacgactatctgactatgcccgacgtcatgaattggaaaaggtcaggacaggattcgttgacttcgaaacaggtgaaatagtggatgcggggaaataccgacaaatagaaagagacttccccagcccctggccatactttcgggatgaattattaacaagattgaatacagacgacccagccgaacttagagaaagaatgcaatctttgggatcctatccaccagaagcacttgaaacacttagaccaatgtttgtgtcaagagcacctcaacgacgaaacggaggagcagcacacaaagataccatatatagacaaacagaacgattaaagaaagttggctcggtaacacaaaaagttccattagcagcactaaatcttagagacttagagaatctcgtagacccacataggaatgaaaaactttacgcagcaatacgagcacgacttgaagcccatggaggaaaaggagagaaggcttttcccccaaataatcctctcagaaaacctgatagagacggaaatcctacgggaccaatagttagaactgtaacgttagtaatagacaaaatgtcaggcattccagtcagaggtggagtagcgaaaaatgacactatgttaagagtggatatctttcgaagtaagaaagacggcaaatttcacctagtaccattgtatgtacaccatgcagttgcaaaacaattacctacaagagcagtaatcgcatataaagatgaaggagaatggactccgataaataatcatgattttgattttctgtttgcattataccctaatgatttagtacgaataaccctaaagaaagaaagacactttggatactatgcagggtgcaatagagcaacaggagcagttagcatatgggcacatgacagaaaccaacgaattggaaaagacggatttatagatggaatcggagttaaaacagcattaagtgttgaaaaatttcatgtggacacactaggaaacgtatacccagcacctcctgaaactcgaagaggcctcgcttga

SEQ ID NO: 5093 - RNA, 3357 nt, synthetic construct
  misc_feature 1..3357: note = Cas9 variant
  source 1..3357: mol_type = other RNA
atgggaacgagatattcatttgatataggaacaaattcaatcggatgggccgtgtggagaacaggaagagatccaaaaggtatattcggagagaaagacgcacctcttgaattattgggggcaggggttaggctctttaaagacgggagaaaccctaaagacggtcaatcactagcgactatgcgaaggataccacggcaagctcgaaaacgaagagatagatttgtattaagacgtgaagctctagtagctgcattaattgaagcaggactgatgcctgcttctgaaaaagaacgaaaagcattagctgatttagacccgtaccaactgagagccgcaggattggacaaagcattagccccacatgaactcggtagagcaattttccacctacatcagaggagaggattcaaaagcaacagaaaaacagataggaaaagtgatgatagagataaagggaaaatagctacggctagcgctgcactagctaaaaagtttgaagatgaaaatgccagaacatttggtgaatttctatggagacgtcatagagacccagatatgaaaagacaagcagtattaaaagcacatgatcctgctaaaggcaaaccagacttaagggcggctaaattaagacaaccaacgagaattagattagaagggcaaggagccaccgcactatacgaattttatccaactagagaaatgctatgtcacgagttcgatgcactttgggaagcacaagcccgacaccacccaatgttactaacaagggaagcaggagataaaattagatccatacttttccgacaaagagaactaaaaccaccgctaataggcttatgtacattcgaatatgcggctggagaaaaagaatcaaggttacctaaggccttaccgtcagtacaagcgagagaaatatatgaaaggctaggtcatataagattatcaacaggatcggggacagacagaccattaaaatcatcagaacgagacgatttggctactgctttgttacattgtgggttaacaaaaataaaagttagtaaaacgaaaggattagcgtttaaaaccgaatttagaaaagcgctaaggcttggaggtgaagtgagaatcaactttgaagaaatgggagaagaaggattagtagacttaagaacaaacagattattagtccaagacgatcattacggtccaagatggagggccctaagctggagtggaaaagatgcattcgtcaagaaactattggaagcaacagatgacgacaaattagtggcacgtttaatgacagaagatggattatcagctgtccaagcgagaaatgcagcgtcaatacccttaccagatggatacagtaggcttggtccgacagctaatgcagcaatattacaagcactgatcgacagcagggatgagaatggattcgtagtaacatacgacaaagcagtgcgacgcgctggtgaaaggctcggaaaagactggcatcatagtgatgaacgagatggtgaaatattagacgcacttccatattacggaaaagtacttcaacgacatatacttcctggtatgatggatccggctgatagaaaagacgaagcaaaattttatggtaggatcatgaatcctagcgtccatattgggttaaatcaacttagacgtctagtgaacgcccttatagaaaggttcgggccccctgatcagatagtagtagaactggcaagggatttaaaaatgtctgcaagagaaaaagaacaagaacaaagacgaaatagagataacagagaggcaaatgagaaaagaacgaagaaattagtagaattggggcaagataataacggagaaaacagagctcggctgaaactctatgatgaacaacaaagggcagggaacggagtcgctcattgcccatttacgttagaccccattgggataactcagttgttttctcctgaaatagaaatagaacatgtcttaccgagaagtagaaccctagatgatagtgcagcgaataaagtactatgttttagaacaattaatagaattaagagaggaaaaacgccatgggaagcgtttcacgcagatcctaaatggcccgatattgcagcaaatgctgaaaaactgcccccaaataaaagatggagatttagagaagacgctatggatgtgtttgaggcaagaacaagtggtaaaatggataagacaacactggagcaaatgggattaacaacaggttttcaagcaagacatttaaacgaaacgaaacacatgtccagattggccaaggcctatttaggaaaaatatgcgatccagacgcagtttatgtcacaccaggagcattaacaagtttactgcgaggcaaatggggtttaaactcaatactatcagatgataatttaaaagacaggactgatcacagacatcatgcaatagacgcaattacgataggagcgatgacaagatcattattgcttgaattaaacacattagctggtaaagcagaacagagcgattacgatgatgtagtcgggaaggtaccatggccattcgacaacttccgagacgcagttcggtccgttgtagatagagttgtagtatcaaataaaccagaacacggaaaacagggagctttacatgaggatacagcgtatgggatagtcggggacgaagcagaggcagaagagataggaaatctcgttagaagaaaattgcttgttgacctaacaccaggtgaagtagaccggattcgagatgcgggactaaggaaagcaatgcaagcagcagttgcacccagcagagatgctagaggaaaagtctctgatgctaagggattcgcagcagcattagacacttttgcaaaagcacaaggtatgagacgaatcagagttggaaaagaagacatgtcagcagtaacgatccatgatagacaaacagataaagcatataaagcagtagcaccaggcgaaaatcaccacgtagatgtcgtgcagatgagagacggtgcatggaaaggtttcgctgtaacggtatttgaagcaaaccagaaggattttagaccacaatgggaaagagagaagttaggaggtaaattagtaatgagattacataaaggtgatgcagtagaactagaatcatctggagttagactggtaaaatttgtacagcagatatggatgaaatcaaatttagtactcttaacagaacataatgaaggaggggacctacaaaaacgacaccaggatgcagatgacccgttccgatgggatttcgcaaatattggaaaattaaaagaaagaggatgtgtcgctgttaaagtggatgaattaggtagggtaacaaaaagaatttcaaatacatga

SEQ ID NO: 5094 - RNA, 3360 nt, synthetic construct
  misc_feature 1..3360: note = Cas9 variant
  source 1..3360: mol_type = other RNA
atgggatacagaataggattggacgtaggaattacatcaacaggctacgcggtattaaaaactgataaaaacggcctaccatacaaaatactcacgcttgattcagtaatatacccgcgagcagaaaacccacagacaggcgcttcactagcagaaccaagaagaataaaaagaggactaagaagacgcacaagaagaacaaaatttagaaaacaaagaacgcaacaattattcatacacagcggactactatcaaaacccgaaattgagcaaatattagcaactccacaagccaaatactcggtatatgaactaagagtagccggtctagatagacgattaacgaactcggagttatttagagtgttatatttcttcataggccacagaggattcaaaagcaatagaaaagccgaactaaacccagaaaatgaagcagataagaaacaaatgggccaactcctaaattccatagaagaaataagaaaagccatagcagaaaaaggatacagaacagtcggcgagctgtatcttaaagatcctaaatacaacgaccataaacgtaataaaggttatattgacggatatttatctactcccaaccgacaaatgttagttgatgaaataaaacaaatcttagataaacaaagggagttagggaacgaaaaattaaccgacgaattttacgcaacatatttgttaggagacgaaaatagagctggaatttttcaggcacaaagagatttcgacgaaggtccgggggcaggtccttacgcaggagatcaaatcaagaaaatggttggaaaagacatattcgaaccaacagaagatagagcagcgaaagcgacttatacattccaatacttcaacctccttcagaaaatgacaagtctgaactaccaaaacacaacaggagatacttggcatacactaaatggcctggatagacaagccatcatcgatgcagttttcgcgaaagcagaaaaaccgacaaaaacttacaaaccaactgacttcggagagttacgaaaattattaaaattaccggatgatgctagattcaacctagtcaactatggcagcttacaaacgcaaaaagaaatagaaaccgtcgaaaagaaaacaagatttgttgattttaaagcatatcatgacctagttaaagtcttacctgaagaaatgtggcaatcacggcaactcctagatcacataggaacagcactaacactttattcatcagataaaagaaggagaagatactttgccgaggaattaaacttaccagctgaactgatcgaaaaactattaccacttaatttcagtaaatttggacatctatccatcaaaagcatgcaaaatattattccatatctagaaatgggacaagtgtattcagaagctaccactaacactggatacgactttcggaagaaacaaatatccaaagatacaatcagagaagaaatcacaaatccagtcgtaaggagagcggtcactaaaacaataaaaatagtagaacaaataataagaagatacggaaaacctgacggtattaacatagaactagcaagagaactaggaagaaattttaaagaacgtggtgatatccagaaaaggcaagacaaaaatcgacaaactaatgataaaatagcagccgaattaacagaactaggaataccagtcaacggccaaaatataatacgatacaagctgcacaaagaacaaaacggagtcgacccatacacgggagatcaaataccctttgaacgagcattctcagaaggctacgaagtagaccatataataccatactcaatctcatgggacgatagctatacaaacaaagtattgaccagtgcaaaatgtaatagagagaaaggcaacagaatacctatggtatatcttgccaataacgaacaacgattaaatgcactaacaaatatagcagacaacataattcgcaattcacgaaaaagacaaaagctactaaaacaaaaactaagtgatgaagaattaaaagattggaaacaaagaaacataaacgatacgagatttataacgcgagtactatacaactactttagacaagcaatagagttcaacccagaattagaaaagaaacagagagttctccctctgaacggtgaagtaacatcaaaaattagatctcgatggggattccttaaagtacgagaggacggagacttacaccatgccatcgacgcaaccgtaatagccgctataacacctaaatttatacaacaagttaccaaatatagtcaacatcaagaagttaaaaacaaccaagctctatggcacgatgcagaaattaaagacgctgaatacgctgcagaggcccaaagaatggatgcagatcttttcaataaaatatttaatggattccctttaccttggccagaatttttagatgaactattagctagaataagcgacaaccctgtcgaaatgatgaaatccagatcctggaacacttataccccaattgaaattgcaaaattaaaaccagtatttgtagtccgactcgcaaaccataaaatcagcggcccagcacatctagacacaatacgaagtgcaaaattatttgatgagaaaggcatagtactctcaagagtttcaattaccaaactgaaaataaacaagaaaggccaagtagcaactggagacggcatctacgatccagaaaacagcaacaatggtgacaaagtagtatactccgcaatacgtcaagcgttagaagcgcataacggaagcggcgaactagcctttccagatggatatctggaatacgtagatcatgggaccaaaaagctagtcagaaaagtcagagtagctaagaaagtatccctaccagtaagattgaaaaacaaagcagcagcagacaatggatcaatggtacgcatagacgtattcaacacaggcaagaaattcgtctttgtacctatatatatcaaagatacagtagagcaagttctacccaataaagcaatagctagggggaaatcactatggtatcaaattacagaatctgatcaattctgcttctctttatatcccggagatatggtacacatcgaaagtaaaactggcataaaaccaaaatactcaaacaaagagaacaatacttcagtagtcccaatcaaaaacttctatggatactttgacggagcagacatagcaacagccagtattcttgtaagagcacatgactcatcatacaccgcacgtagtataggaatagcaggtcttttaaaatttgaaaaataccaagtagattatttcggtagataccacaaagtacacgaaaagaaaagacaactatttgttaaaagggatgaatga

SEQ ID NO: 5095 - RNA, 3360 nt, synthetic construct
  misc_feature 1..3360: note = Cas9 variant
  source 1..3360: mol_type = other RNA
atgaatgacaagaaaaatctaggaccgttgacattcggatttgacataggaatagctagtgtaggttgggcagtgctatctcctacaagaatcgtcgatttgggagttaggtgctttgataaagctgaaacagcaaaagaaggagaaagtctaaatctcgctcgaagaagtgctagactaatgagaagacggttacgcagacgagcttggagattaataaaactcgcaagactattaaaacatgaagggctaattgcagacacaaaaactttcatacaaccatcagcttcacatgcttcaccatggcaacttaggaaagacggattagacagagcactttctccagaagaatgggccagagtgctataccatctatgcaaacatagaggcttccactgggttagcagggcagaagcaaggaaagcagacggagacactaaaggagaaggaggaaaagtaaaacaagggctagcaagtaccacaaaattaatgaacgataaatcgtatcgaacagcagcagaaatggttctcgctgaatttccatcagcccagagaaacaaacggggagagtatactaaagcattaagcagagaattattagacaatgagttaaaacaactttttgaaagacaaagggagtacggcaatccacatgcggatacaaacttagaggcaaaaataagaggatccggagaccataaatcaggattattctgggaacaaaaacccgctttatcaggaaacgatttacttaaaatgcttggtaaatgtacatttgaaaaacaggaatatagagcacccaaagcatcatttacagcagaaagacatgtgtggctaacacggttaaataacttgcgaattatagttgatgggagaaccagaccgttagcggatgccgaaagaactatggcgctaagtctaccatatgaacaagtaggcgactttacgtataagcaactcagggctgcattagtcaaggcaggattaatgcctgatagtttcaaatttgcatccctagcatatccaagcgaatttcagaaggcagaaggaaaagcaaaagatcctgaatcagctgccttaactaaactagcagcgtggcaggaactaagagctacgcttaagaaagcagatttagaatctgaatggcaacaaataagttgtgccgctcttgaaggtcaacctgaaactttagatgaaattgcaggagtattgtcagttttcaaagatgatgatgaagttttgaatgaattgcaaaaactcggactcccaggaggagcaaaaactgaaaatgctttactcgacatcagatttgacaaatttcatgcattatcattaaaggctttgagaaaaatcgtaccctatatggaaagaggtctacgatatgatgaggcttgtgaaagagcagaatatcatcatagccaactacataaagtaggtgagggtaatcgaaaatacttaccacccttatacaaatcccgtgacaaagatggaagaatggtctttaatgacgaactcggcgatataccccggaatcctgtagtactgcgatccttaaatcaagcaagaaaagtattaaacgctctaatcgcaagatacggatcaccgagttccgtccatatagaaatggcaagagaactatcaaaaccatttgatgagaggatgaaagttggcaaagaacaagaggcttatagagaaagaaacgaaaaagataaacaaacttttgtagcagagttcggtatagtcggcgcagccaaagggggtgaatttgaaaaatggaaactgtatcgtgaacaacaaggaaaatgtgcatatagtatacaaggaatagaccttaatagattgttggaaccaggatacgttgaaatagaccatgctttaccttactcacgaagtttcgatgatagtaaatccaataaagtattagttttggcagcagaaaacagaaataaaggcaataggacaccttacgaatacttagatggagaacataattcagaacgatggaggcaatttgtcggctttgtcgagtcaaataaactatatagacaagcaaagagaagtagattactaagaaaagattttggcaaagaacaagcagatgaatttagagaaagaaatcttaacgatacaagatatgtttgcaggtttttcaagaatcaagttgaacaatttttgaaacttgcggaaggatcagaatcaaaaagatgtgtagtactttctggacaacttaccgcattcttaagggcaagatggggactaattaaagtgagggatgaaagtgaccgacatcacgcattagatgcagtcgttgtagcagcatgcacacatggtatggtaaaaagaatgagcgattacgcaagaagaaaagagcttgatcaagtagccgagggctttgtagacgtagaaacaggtgaaataattaatgcagcaatgtttcaacaactccacgagcatttccctgacccgtggccccacttccgagacgaagtccaaatgagattaaaaatcgacgacccagcacaattaagatctgatttgctacgtctaggaaattacgctgaggaggatgtacatgcagtcaggccattatttgtttcacgagccccgcaacgtagaaatagcggtgctgcccataaggaaaccatatatggccaacctgaaagattaaaagcacaagggggagtgacggaaaaagtggcattaacagcactaacaatgaaagatcttgatcgtttaatagatccccatcggaatgaaaaattatacgcagccatacgaaaacggcttgaagagttcggaggaaaagcagataaggcattcgcagcatcaaatccactacacaaaccggataaagaaggaaatcctactggaccgatcgtaagaactgtaacactagaaatagacaaactttcaggagttccagtaagagggggaatagctaaaaatgataccatgctaagagtagatgttttcaccaaagcaggaaaatttcatttagtaccagtatacgtacatcataaggttacaggactacctaaccgagcaattgtagcaagcaaagatgaagacgaatggacggctatagatgactcatttgaatttttattctcactatacccaaatgacttagtaacgatcacccagaaaggaaaagcaccagtacgtggctattatgctagctgccatagaggaactggtgctttttcactttgggctcacgatagagcaagtagtgtcgggaagggaggacaaatagaaggaataggaataaaaacagcattagctgtccaaaaatataatgtagacgtactaggtacaacctatgcagcacccttagaacaacgaagaggattagcctga

SEQ ID NO: 5096 - RNA, 3363 nt, synthetic construct
  misc_feature 1..3363: note = Cas9 variant
  source 1..3363: mol_type = other RNA
atgaggaaagtaacaataggattcgacataggggtatctagcgtgggatggtccgtagttgatatgaacaacggagcaatcgttgaaactggtgtgagactattttcagcgtcatcagccgaaaataacgtagaaagaagaaataatcgtcaaaccagaagactaaatcgacgtaggaaaaacagattaaaagatgttaaatacctattagaaacgaatcatttcacatttgatcaagaacaaggtacaaatccttacgaattaagggtagccggactacacagaaaactaacacgatcagaactagcaagagcactataccacctagtaaaaagaagaggtattagctatgacctcacagacatagaagaagaagaaatagtgacaaccagcgcatacaaaacagcattgggcaaaaatcaatcacaattggccgagaaaacaccaggggaaattcaatttgccagactcgaaaattatggaaaagtacgcggatctatagaaatcaacgaacaagacatactactaaacatatttccaacaagcgcatacttaaacgaagcaaaaagaatattagctacacaaagaaaattctaccccgaaataacagaagcattcatagaaaaatactgcacaatcctcacgagaaaaagagaatactatgtaggtccaggaacggagaaaaacagaaccgactacggtatctaccgaactaatggagaaacccttgataatctatttgaaatactaatagggaaagacaaattctacccaaatgaagaaagagctgcaggaaatagctatacagcacaactattcaacttcgtcaatgacctaaacaatctgaaaatacagacgatagaagaccaaaaactcacacccaaacaaaaagaagaaatcatagaacaagtgaaaaccgccgagaagaaagtttcactcatacaattaataagtaaaataacaaaaacaccaaaagatcaaataacaggatacaggacagataaaaatggaaaacctgacctacactcaatggcagtatttagaaaagttagaaaacaatttttaacaatggaaatagacatcttacactggcccgatgaacttcttaacgatttaggaaggctcctaacattaaacacagaaaaaggagaaatcagaaaacaactaacgaaagacttcatgaaacgctaccctatactaaacgaacagcttgtcgatcaaataattgaaaaccggcacatctttgccgttagcggtaatcataaatggcaccgattctcacttaggacaatgaacgaactactacctgaaatgctagccacaagtaaagaacaaatgacactgctatctgagagagggatgataaaacaacataaacgtgactacctaaaaatgaatgaattagacgcccgactgatatccgaagaaatttataatcctgttgtaggaaaatcagtacgagaagcaatcaaattattcaacgaattaatgaagaaataccaagaagtaaggtatgtcgtactggaaatgcccagagacgacaacgaagaaaaagccaagaaagaactccagaaatatcaaaaagaaaatgaaaacgagaaagaaatagcactatcagaatttcaaagaaaaggattctttagcgatgcacaattagaacgagcattaataaaagatagaaaactaaaaactaaaattagattttggcatcaacaagaaggtaaatgcctttattctggacaaatcataacaccggtcgagctattaaccaacagtttctcatttgacatcgaccatattataccacaaagcgttagtttcgatgactcattaaacaacaaagtattatgcacaaaagaaatgaacgatcaaaaaggaaaacaaacaccctacggcttcttactaaatggaaacggtcaaggattcgatcgctttaaagcaatggtaaacgccaaccgtctaatgtcaaaagggaaaaagaaaaacttattattcatggaagatctaaacaatatagaaacacgaaaaagattcattgcaaggaatctcgtagacacacgatacgcatctagagtagtactaaacgaaatacaacaatacttaagagccaaaaacaaagatacccaggttgcagtagtaagaggaaaattcacggcaacccttcgtaaacattggaatataaacaaaagtagagaaactcaccaccatcacgccctagatgcttctataatagcaattactccactattatcggtatggaaaaagaaacaaacactaataccaaaaactttatctgaagaaaaactagaatttgaatatgacgatatagttgaagatacaatcttcgaaaaagcactttaccaattacctaaagaaaacttcaaagaacaattaaataactcacagccaaacataaaattttcatatcaagtcgacaagaaaatgaacagaaaagttagcgacgcgacaatatatagcgtaaaacaagcaaaattatcgagcgacaaacaaagcgaagagtacgtactagcaaaaataaaagatatctatagcgtagaaggatataaaaccttcgcaaaaatttatgaaaaggacaaatcaaaattcctaatggctcaaaacgacccaaaaacattcgaaaaacttgaagaaataatacaatcatacccaagtactagagaaataatcgtaggagaaaaagtgaaagtagtcgacgtatcaccattcgaactgtaccgaaaggaatacggatacatcacgaaatatgcaaagaaaaataacggaccgataatccgacaacttaaatattatgaccacaaaataggtatgcatttagatataaccaaccagaaaaataatggcaaaggcaagaaagtaatattacaacaactaaaatcgtggaggacagacgtctattacaatcacgaaaaacaggaatacgaaataatgggtttaaaatattccgatctacgttttaagaaagaccaatacggcatacctaaagaaaggtaccaagaagtaaaacaaatggagaaaatagcaccacagagtgaattttgtttttcattataccgaaatgataggataaaagtcttaaataaagagacagatgaagaagttgaacttctattcggagcaagaaactacacgagtgcaggatacgtcgacctgaaacccatagacagagtagaatttggcaagaaagaatggattccagtataccaatatgctacaagtgacggaaaatgcaagaagaaatttgctaagaaaggatacgaaatttataaagtaaacacgactatactaggagaaagttactacatcaagaaagaaagaatgctaccgaaaaatatattagattga

SEQ ID NO: 5097 - RNA, 3363 nt, synthetic construct
  misc_feature 1..3363: note = Cas9 variant
  source 1..3363: mol_type = other RNA
atgtcagacctagtactaggattagacataggaataggaagcgtaggagttgggatactaaataaagtaacaggagaaattatccataaaaatagtagaatatttcccgcagcacaagccgaaaataatctagttaggagaactaaccgacaaggacgacgacttacaagaagaaagaaacatagaagagttcgactcaacagattatttgaagagattgggctaataacggactttacaaaaataagtattaatttgaacccctatcaactaagggttaagggcctaacagacgaactgagtaatgaagaactgttcatcgcccttaaaaacatggtaaaacacagaggaataagttacctagatgacgcttcagatgacggaaattcatcagtcggagattacgcacaaatcgtaaaagaaaattccaaacaacttgaaacaaaaacaccaggacaaatacaattagaaagataccaaacctacggacaactaagaggtgatttcaccgtagaaaaagatgggaagaaacacagattaatcaacgtgtttcctacatcagcatacagatcagaagcattgagaatccttcaaactcaacaagaatttaacccacaaattacggacgagttcataaacagatacctagaaatattaacaggaaaacgcaaatattatcacggacccgggaatgaaaaatcaagaactgactacggaagataccgcacatcgggcgaaacactcgataacatattcggaatcttgataggtaagtgcacattttacccagatgagttcagagcagcaaaagcctcatacaccgcccaagaatttaacctgctaaatgacctaaataaccttaccgtaccaacagaaactaagaaactgagtaaagaacaaaagaaccaaatcattaactacgtgaaaaacgaaaaagcaatgggaccagcaaaactattcaaatatattgcaaaattactctcatgtgacgtagcggacataaaaggatatagaatcgacaaaagtggaaaagcagaaatacatacattcgaagcataccgaaaaatgaaaacactagaaacactagacatagaacaaatggatagagaaaccttagacaaactagcgtacgtactaactttaaacacagaacgcgaaggtattcaagaagccctggaacacgaatttgcagatggatcttttagccaaaagcaagtagatgaattagtacaatttcgtaaagcaaactcatcaatattcggaaaaggatggcacaatttctcagtaaaactaatgatggaattaattcctgaattatatgaaacttccgaagaacaaatgaccatattaacaagacttggtaaacaaaagacaacatcatcatcgaacaaaacaaaatatatagacgaaaaattactaacagaagaaatatacaacccagtggtagccaaaagcgtaagacaagcaattaaaatcgtcaacgccgctataaaagaatacggagactttgataacatagtcattgaaatggccagagaaacaaacgaagacgatgaaaagaaagcaattcagaaaatccaaaaagcaaacaaagatgaaaaagacgccgcaatgttaaaagcagcaaaccaatataacgggaaagcagaactcccgcactcagtcttccacggacacaaacaacttgctaccaaaatacgactctggcaccaacaaggcgaaagatgcttatacacaggaaaaaccataagtatccatgacttgataaacaatcccaaccaattcgaagttgaccatattctaccactaagtattacttttgacgactctctagccaataaagtgctagtttacgcaacagcaaaccaagaaaaaggacaaagaacaccataccaagcactagattcaatggatgatgcttggtcatttcgagaactaaaagcatttgtcagagaaagcaaaacactgtcaaataaaaagaaagaatacttactgacagaagaagatataagcaaatttgacgtccgaaagaaattcatagaaaggaatttagtagacacaagatacgcaagccgggtggttctaaacgcactacaagaacactttagagcccacaaaatagacacgaaagtctccgtggtaagggggcaattcacttcacaactaagaagacactggggaatagagaaaacacgagatacatatcaccatcacgcagtagatgccctgattattgcggccagctcccaactcaacttatggaagaaacagaaaaacacattagtatcttattccgaagaccaattgctcgacattgaaaccggagaattgatatcagacgacgaatacaaagaatccgttttcaaagctccctaccaacactttgtcgacaccttaaaatccaaagagttcgaagatagtatactattcagctatcaagtagatagcaaattcaacagaaaaataagcgacgcgactatatacgcgacacgccaagcaaaagtgggaaaagataaagcagatgaaacatatgtactcggcaaaataaaagatatttatacccaagatggttatgacgccttcatgaaaatttacaagaaagataaatcaaaattccttatgtataggcacgacccacaaacatttgaaaaagttatagaaccaatattggaaaactatccaaataaacaaatgaacgaaaaaggaaaagaagttccatgcaacccgttcctaaaatacaaagaagaacatggatacataagaaaatactctaagaaaggaaacggcccagaaataaaatcactaaaatattacgatagcaaactcggaaaccatatagatatcacgccaaaagatagcaataataaagtggtacttcaaagcctaaaaccttggaggacagacgtatactttaacaaaaacacaggtaaatatgaaatcttaggcttaaaatacagcgacatgcaattcgaaaaaggcacaggaaaatattctatatccaaagaacaatacgaaaatataaaagtacgagaaggcgtagacgaaaactcagagttcaaatttaccctatataaaaacgacttactgttacttaaagactcagaaaacggagaacaaattttattacgtttcacatcaagaaacgacacttccaaacattatgtagaactaaaaccatacaacagacaaaaattcgaaggttccgaatatttaataaaaagcctcggtacagtcgtaaaaggtggccgatgcataaaaggtttaggaaaatccaacattagcatatacaaagtccgcacagacgtgctaggaaaccaacatataattaaaaacgaaggcgataaaccaaaactagatttctga

SEQ ID NO: 5098 - RNA, 3363 nt, synthetic construct
  misc_feature 1..3363: note = Cas9 variant
  source 1..3363: mol_type = other RNA
atgggactcgatataggggtcgccagtgtaggcttctcagtactagatatagacaaaggcaaagtaattgaactaggggcaaggctgttctcagcaaccgtagcagctggaaaccaagatagaagggacatgagaggagcacgcagactcctgaatagaaacaaacaaagacgccaagacactgggaaactttttaaaaaatttggactaattgatgacttcgataagggatcattctacgataacttcaaccaaaaccttaacccatatgaactaagggtaaaaggcctaaccgaacaactaacaaaagaagagttagcagaaagtttataccaaatagtcaaacatcgcggaataagctatgcactcaaagacgcagacgtagatgaaggaggaacagactacagcgtaagtctcaagataaattctcaagaactcgccgaaaaaacccccgcacaaatacaattacaaagattaaatgactacggaaaagttaggggacaagtagtaataggagatgacccagacaaccaaaaagtcctgcttaacgtgttccccaccagtgcatacgaaaaggaagccaaacaaataatagcaacccaacaacaattctacccagaaagtttaacggataagtttactgaagaatattgtcaaatattaacacgcaaaagagactatttcgtcgggcccgggaacgaaaaaagcagaaccgattatggaatatacaaaactgacggacgtacactcgataacttattcgaagaattgataggacatgataaaatttatccagaagagttaagagcatctgctgctagttatacagcacaattatttaatgttttaaatgatctaaacaacctaagaattttgaattatgaagacggtaaactaacaaaagaagacaaagagaaaataatcgcagaaattaaaaataatacgacaacaataaatatgctaaatgtaatcaaaaaagttgcaggctgttcaaaagatgatataaaaggatttagagtaaacgaaaaagacaaacctgaaatatcatccatgcctgtgtacagaaaaatccataaagatttgttaaaagcgggagtagacatatcagattggccagtagaattcattgacgagctaagctttattctaacacttaatacagaaaatggagaaataagaaaacaactcaacaatagactcgcaccaaaatttgatttcctcaacgctgatttaatacaactcataatagataacaaggactcattcgaaataaaaaccaacaataagtggcatcgattctccgtgaaaacaatgaataaattaattccagaaatgatggaaaggccagtagaacaaatgacattattaaacgaaatgggattagtaaaaaaagataagaaaaggtttgaaaataataaatatctaccgtacaaagaaatagcaaaagatatatttaaccctgtagcttccaaatcagtaagggaagctttaaaaatagtaaacgcagttctcaaaaaatacggacacatagattacctagttgtagaaatgccgcgcgataaaaacttaaaagaagaacaagataatataaaagaattccaaaacaaaaacaaaaaagcaaaagatgctgccttcgaggcttttgtaaaaagcgttggatcggaacaaagagttaaagaagcgctaagcaaaaaccgaaaactccaaatgaaaatgagactttggtaccaacaacaggaaatcgacccttataatggaaaaacaatcgacgcgaccgatctaatcaacaatcccgacaaatttgaaatagaccacataattccgcagagcatctccttttacgattccataaacaataaaaccctgtgtttcgcaagcatgaatcaagtcaaagggcaaaaaacaccatacgaattcatgctagaaggacatggacaatcatacgacaaatttaaagcaacagtgatggcaaataagaacttcggaaaagccaaacgagcaaactacttatttgaagaaaatgtatctgacattgaaaccaggaaaagattcctgtctcgaaacttggtcgacacaaggtacagctctagagtagtactaaattcactccaagactttttcagagaaaagtctgcagacacaaaagtaaccgtcataagagggaaattcactagcaacatgcgcaaacattggcacatagacaaaaccagggaaaccttccaccaccacgcaatagatgcatcaattatagcagctacacccttcctacgcatgtggaaaaaaggtggcacaatcttcccagtaaaagttggcgaggaatcaatagacatagaaacaggagaaatattggacgacaaaaactttgataaagcaatgtacgaagagccttactcaggattcgtttcagaaataatgaacgctgacgacagaatcaaattttcacaccaggtagacaaaaaaatgaaccgtaaagtctcggatgccacaatttacagtacaagaacaggtaaacttgcgaaagacaaaaaagacgcagaatacatagtggcgaaagttaaagatatatatagtgtagacggttttaagaaatttaaaaaagtatacgataaagacaagaccaaattcctgctatacaaatacgacccaagaacatttagtaaactagagcgaataatatctgactgtccggataaagtagaaaaagtacaaacaaacggaaaagtcaaagcagtagacatatcaccatttgagatgtacaggagagaccacggtatgattaaaaaatatagtaaaaagggcaacggtcctgcaatcaaacaactaaaatacttagacaaaaaactgggctcccatatagatatcacgccggctaacgcaaacggaaaacacgtaatcctacaaagtttaaaaccatggaggaccgacgtatacctaaaccatgagacaggagaatacgaaatcatgggtatcaaatactcagacttaaagttcaataaaaatgaaggatatgggataaaaaaagacaaatatttagaaataaaaaaagtcgaagaagtatcagaaaaatccgaattcatgttcagcctttatagaaaagacagagtaaaagtccaagatatgaaaacaggggaaagcgttgaacttctattctggtccagaaacttcagcaacaaaaaatacgccgaactaaaaccaattagtcaagcagaaaacgataagaaacttccagtatacggaaaaggacgcctaataaaaagattaataccaaaaaactgcaaaatatggaaagttaacacaactatattaggcgacccatactatctggaaaaagaatcagattcgcctaaagatatactggactga

SEQ ID NO: 5099 - RNA, 3366 nt, synthetic construct
  misc_feature 1..3366: note = Cas9 variant
  source 1..3366: mol_type = other RNA
atgagcgatctagttttaggacttgacataggaataggcagcgtcggagtaggcatcttaaataaagtaacaggtgaaataatacataaaaattcacgtatctttccagcagcccaagcagaaaataacttagttcgccggacaaacagacaaggccgaagactcacaagaaggaagaaacacagaagagtcagactaaaccgactcttcgaagaatcaggactgatcacagatttcacaaaaatctcaattaacctaaacccatatcaattacgagtgaaaggactaacagatgaattaagcaacgaagaactatttattgcccttaaaaacatggtaaaacatcgaggtatatcatacttagatgacgcgagcgacgatggcaattcaagcataggagactacgcacaaatagtcaaagaaaacagtaaacaattagaaacaaaaacaccaggtcaaatccaactcgaaagatatcaaacttatgggcaattacgtggcgattttaccgtagagaaagatggaaagaaacatagattaataaatgttttcccaacatcagcatatcgttcagaagcacttagaatattacaaacacagcaagagttcaatccccaaataacagatgaatttgtaaacagatatctagaaatattaaccggaaaacgaaaatactaccatggtccaggaaacgaaaaatcaagaaccgattatggtagatatcgaactaacggagaaacattagataacattttcggtatactgatcggaaaatgtaccttttatccagatgagttccgagcggctaaagcaagctacacagcccaagagttcaacttactaaatgatttaaataacctaacggtgccaacagaaaccaagaaactgagcaaagaacagaaaaaccaaatcataaactatgttaaaaacgaaaaagcaatgggaccagctaaactgtttaaatacatagcaaagttattaagctgtgacgtagctgacataaaaggataccgaatcgacaaaagcggcaaagccgaaatacacacattcgaagcatataggaaaatgaaaacactggaaacgctggacatagaacaaatggatcgagaaacattagacaaactcgcttacgtacttacacttaacaccgaaagggaaggaatccaagaagcgttagaacatgagttcgctgacggatcattctcacaaaaacaagtagatgagctagtccaattccgaaaagctaacagtagtatattcggtaaaggctggcacaactttagcgtaaagctaatgatggaattgatcccagaactttatgaaactagcgaggaacaaatgacaatattaacaagactcggaaaacagaaaactacatcatcaagcaataaaaccaaatatatcgatgaaaaattgttaacagaagaaatctataacccagtagtggccaagtccgtaagacaagcaataaaaatagttaacgcagcaattaaagaatacggagacttcgacaatatagttatcgaaatggcaagagaaacaaacgaagacgacgaaaagaaagctatacagaaaatacaaaaggctaacaaggatgaaaaagatgcggcaatgctaaaggccgccaaccaatacaacggtaaagcagaattaccccatagcgtttttcacggccataaacaactagcaacaaaaatccgtctctggcatcaacaaggagaacgatgtttatacacgggaaaaacaatatcaatacatgacctcatcaataattcaaaccaattcgaagtggatcatatactaccactatcaataacattcgacgactctttagcaaacaaagtcctagtatacgcgacagcaaatcaagaaaaaggacaaagaacaccataccaagcattagactccatggacgacgcatggagcttcagagagctgaaagcatttgtaagggaaagtaaaacactaagcaacaagaagaaagaatacttattaacagaagaagatatttcgaaattcgacgtccgcaagaaattcatcgaaagaaatctagtagatacaagatacgcatcaagagtagtattaaacgccctccaagaacactttagagcacataaaatagatacaaaagtttcagtagtaagaggacaattcacaagccagctacgacgacactggggaatagagaaaacaagggacacatatcatcatcacgctgtggatgcactaatcatagccgcatcatcacaactaaatttgtggaagaaacagaaaaatacattagtgagctattcagaagaccaattattagacatagaaactggagagctaataagcgatgatgaatacaaagaatttgtatttaaagcaccataccaacactttgttgatacactaaaaagcaaagaatttgaagattctatattattttcctaccaagtagattcaaaattcaacagaaaaatatctgacgctaccatatacgctaccagacaagccaaggtaggcaaagataaagcagacgaaacgtacgtactcggaaaaataaaggacatatatacacaagacggatatgacgcatttatgaaaatatataagaaagacaaaagcaaattcctaatgtacagacacgacccgcaaacattcgaaaaggtaatagaaccaattctagaaaactacccaaacaagcaaatgaacgaaaaaggaaaagaagttccatgcaaccccttcctcaaatataaagaagaacacgggtacatacgaaaatatagtaagaaaggcaacggaccggaaataaaaagtttaaaatactacgactcaaaactcgggaaccatatcgatataactccaaaagacagcaataataaagtagtcctacaaagtgttagcccatggcgagcagatgtatattttaacaacacaacaggtaaatacgaaatactaggactcaagtacgccgacctgcaatttgaaaaaggcacgggaacatataaaatatcacaagaaaaatacaatgatataaagaagaaagagggtgtagatagtgatagcgaatttaaattcacattatacaaaaatgatttactcttagtcaaagaaacagaaacaaaagaacaacaattattccgatttttatcaagaactatgcctaaacaaaaacattatgttgagttaaaaccctatgacaaacaaaaatttgaaggtggagaggcactaataaaagtactaggaaatgtggctaacggagggcaatgtataaaaggtctcggaaaatcaaatatatcgatatacaaagttagaacagacgtattaggcaaccaacacataatcaaaaacgaaggagataaacctaaactcgatttttga

SEQ ID NO: 5100 - RNA, 3366 nt, synthetic construct
  misc_feature 1..3366: note = Cas9 variant
  source 1..3366: mol_type = other RNA
atgaacggcctagtacttggattagacatcggaatagcttcagtaggtgtaggcatactagagaaaaacagtgggaaaattatccacgcaaacagtagattattcccagcggccacagcggacaacaacgtagaaagacgtaaaaacagacaagccagaagactaaacagacgaaagaaacaccgaggtgtgagattccaggacctgttcgaagactacggattattaactgatttttctaaagtatcgataaatctgaatccatacaggttaagagtagacggcctgaacaaacaactaacgaatgaagaactattcatcgctctgaaaaacatcgttaaaagacgcggcataagttatttagacgacgcttcagaagacggaggaacagtcagtagcgattatggaaaagccgtcgaagaaaaccgaaaattattagcagaacaaaccccaggacaaatacaacttgaaagattcgaaaaatatggacaactgagaggagacttcacagtcgtagaaaacggcgaaaaatgcagattaataaatgtattcagcacaagcgcatacaagaaagaagccgaaagaatattgagaaaacaacaagagtttaatagtaaaataacggacgagttcatcgaagattatctaaaaatactgacaggcaaaaggaaatactatcacggacccggaaacgaaaaatcaaggacagattatggccgattcagaaaagacggaaccacgttagataacatattcggcatactcattggaaaatgcacattttacccaaacgaatacagagcctcaaaagcatcctatacagcccaagagttcaacctactgaatgacttaaataacctaagcgtccctacggaaaccaagaaactaagtgaagaacagaagaaaacaataatagaatatgccaaatcggcgaaaacactaggcgcttcaacgcttcttaaatacatagcaaaaatgatagacacaagcgtagaccaaataagaggatatagagtagacgtaaataataaacccgaaatgcacacatttgaagtatatagaaaaatgcaaagtctagaaacaatatctgtaggcgaactaagcagaaatgttctagatgaacttgcacatatactaacattaaataccgagagagaaggaatagaagaagctatcaatactaaactaaaagatagtttttctcaagaccaagtattagaattagtacaatttaggaaaaacaactcatctttattttcaaaaggctggcacaactttagtctaaaactcatgatggaattaataccagagctatatgagacatcagaagaacaaatgacaattttaacaagattaggaaaacagaaatcaaaagaaacttcaaaaagaagtaaatacatagacgaaaaagaattaacggaagaaatctacaatccagtagtagccaaaagtgttcgacaagcaattaaaataatcaatgaagcaacaaagaaatacggaatattcgacaatatagtcatagaaatggcccgagaaaatgacgaagaggacgcaaagaaagactacataaaacgccaaaaagctaatcaagatgagaaaaacgccgctatggaaaaagccgcatttcaatacaacggaaagaaagaattgccagacaacatattccatggccataaagaactagcaaccaaaatacgactgtggcaccaacaaggggaaaaatgcctctataccggaaaaacgatacccatatcggacctaatacacaatcaatacaaatatgaaatagaccatgtccttccattaagcctatcgtttgatgactcactgagcaataaagtcttagtactagctaccgcaaaccaggaaaaaggccaacgcacgccatttcaagcactagattcaatggatgacggatggagctacagagagttcaaaagctatgtaaaagaatcaaaattactaggaaacaaaaagaaagaatatctactaacagaagaagatatatctaaaatcgaagtaaaacagaaattcatagaacgaaacttagtcgataatcggtacagctcaagagtcgtcctcaatgccctacaagacttctacaaagctcacaaatttgacaccacaatatcagtcgtcagaggacaattcacgtcgcaattgaggcgaaaatggggattagaaaaatcacgagaaacgtaccatcaccacgccgtagacgcgttaataatcgcagcatcatctcaattgagattgtggaagaaacacaacaatcccttaatctcatataaagaaggaagattcatagactcagaaacaggtgaaattataagcctaagcgatgacgaatacaaagagctagtcttcaaagcaccctatgatcacttcgttgatactttaagaagtaaaacatttgaagactccatattatttagttaccaagtagattcaaaatataatagaaaaatttcagacgcaacaatatatgcaacaagaaaagcaaaacttgacaaagacaaatcggaagaaacttacgtcttaggaaaaataaaagatatatactcacaagcaggatatgatgcctttataaaaatctacaataaagacaaatctaaattcctcatgtatcacaaagatcctcaaacattcgaaaaagtcatagaagaaatattaagaacatacccatctaaagaacttaacgataaaaacaaagaaataccgtgcaacccgttcgagaaatatcgacaagaaaatggtccaattagaaaatatagtaagaaaggtaacggcccagaaataaaatccatgaaatactacgacaaaaacatccctgagtccttcatcaatataaccccgtctaattcaaataacaaagtcttactcagacaattatatccatggcgaacagatgtttactttaatccacaaacagacaaatatgaactacttgggctaaaatacgccgacttacaattcgaaaaagcaacaggaaaatatagcataactatagacaagtataatgaaatcaaagaaaaagagggagtatcaaaagaatcagagttcaaatttacactgtacaaaaacgacctactattaattaaagacaccaaaaataacgaagaacaaatattccgcttcttatcacgtacaatgccaaatcaaaaccactatgtagaattaaaaccttacgataaagggaacttcgaaggcaaagaaaagattaaagtcttcaaaatgacatctaatggacgatgtataaaaggcttaggaaagaaatacctttcaatatataaagtaaaaacggacatactaggaaacaaacatttcataaagaaagaaggagacgaacctaaattgaaattctga

SEQ ID NO: 5101 - RNA, 3366 nt, synthetic construct
  misc_feature 1..3366: note = Cas9 variant
  source 1..3366: mol_type = other RNA
atgaatggacttgttctgggtctagacataggcatagcatcagttggcgtagggatcttagaaaagaacagcgggaaaataatacacgctaactctcgtcttttcccagcagcaacagcagataacaacgttgaaagacgaaagaatcgacaagcccgaagattaaatagaaggaagaaacacagaggagtaagattccaagacctatttgaagactacggattattaacagattttagtaaagtcagcatcaacttaaacccatatagattaagagtagacggacttaaccagcaattaactaatgaagaattatttatcgcattgaaaaacatagtaaaacggcgcggtataagctatctagacgatgccagtgaagatggtggggcagtaagttctgattatggaaaagcagtagaagaaaatagaaaactacttgcagaacaaactcctggacaaatacaactagaaagatttgaaaaatatggacaagtaagaggcgacttcactgtagtagaaaatggcgaaaaacgtagattaataaatgtctttagtacgagcgcatatagaaaagaagctgagaaaatactaagaaaacaacaagagttcaataatcaaataacagacgagttcatcgaagattacttaaaaattctcactggaaaacgaaaatactaccatggacccggaaacgaaaaatcaagaacagactatggacgattcagaacagacggaacaacactagataacatcttcggagtattaataggaaaatgcacattttaccccaatgaatacagagcatcaaaatcatcatacactgcacaagagttcaatctactaaacgacttgaacaatttaacagtaccaactgaaaccaagaaattatcagaagaacagaagaaagttatagtcgaatacgctaaagaagcaaaaaccttaggagcaagcacattattgaaatacatagtaaaaatgatagacgcatccgtagaccaaataagtggctatcgtgtagatgtaaataacaaaccagaaatgcacacctttgaagtatatagaaaaatgcaatcactagaaacgataagtgtcggcgaactttctaggaacgttttagacgaattagcgcatatattaactttaaatacagaacgcgaaggtattgaagaagcaataaatagtaaacttatgggtgtattttcacaagatcaagtcctcgaacttgttcaattccgtaaaaacaattcatcattattctctaaaggatggcataactttagcttaaaattaatgatggaattgatacctgaattatacgaaacatctgaagaacaaatgacgatactcactcgactgggaaaacagaaaagcaaagaaacaagcaaacgaacaaaatacatagatgaaaaagaactcaccgaagaaatatacaacccagtagtagcaaaaagtgtacgtcaagctataaaaataataaacgaagcaacaaagaaacatggaatatttgataatatcgtaatagaaatggcgcgcgaaaacaatgaagaagatgcaaagaaagattacataaaaagacaaaaagccaatcaagacgagaaaaacgctgcgatggaaaaagctgcttttcaatacaatggcaagaaagaactacctggcaatatattcaatggccacaaagaattagcaacaaaaattcgattatggcatcaacaaggggaaaaatgcctatatacaggcaaaacaataccaatctcagatttgattcataatcaatacaaatatgaaatagaccacatactaccacttagcctcagcttcgacgacagcctctctaacaaagttctagttcacgcgacggctaaccaagaaaaagggcaacgaacaccattccaggctttagattcaatggatgacgcatggtcataccgagagttcaaatcctatgtaaaagacctcaaatcgctctcaaataaaaagaaagactatctattaacagaagaagatatatcaaaaatagaagttaaacaaaaattcatagaacgaaacctcgtagatacccgatatagctcaagagtagtcctaaacgcactgcaagacttctataaatcacatcaattcgacactacaatcagcgttgtaaggggccaatttacatcccaactccgacgaaaatggggcctagaaaaatcaagagaaacctaccaccaccacgcagttgatgcactaatcattgcagcatcatcacaactgagactatggaagaaacaaaacaaccctctaataacatataaagaaggacaatttatagacagtcaaacaggagaaataatatccttaacggacgacgaatacaaagaattagtgttcaaagcaccttatgatcatttcgtcgacacattacactcaaaaactttcgaagacggaatactattctcctatcaagtagactctaaatacaaccggaaaatttcagacgcaacaatatatgcaactagaaaagccaaactagataaagacaaaagtgaagaaacatacgtattgggtaaaattaaagatatatactcacaagcaggttacgatgccttcattaagatatataataaagacaaaagaaaattcttaatgtatcataaagacccccaaacctttgaaaaagtaatagaagaaatattaagaacatatcccagtaaagaaagaaacgacaaaaacaaagaagtaccttgtaacccgtttgaaaagtatcgtcaggaaaacggtccaataagaaagtattcaaagaaaggaaacggaccagaaataaaatgtttaaaatactatgacaataaactgggcaattatatagacatatccccggatggatccgacaatcaagtagtactacaatctttaaaaccatggagaacagatgtatacttcaaccaccagactaagaaatacgaactaatgggcttgaaatacagtgacttatcatttgaaaaaggaagcggaaaatactctatatcaaatgaaaaatataatagcataaaacgaatcgaaggtgtaaatgaacaaagcgagttcaaattcactttatacaaaaacgacctaattctaattaaagattcagaaaacaatgaacaaaaactcttcaggtttaattcaagaaacgacacagccaaacattacgttgaactcaaaccatacgataaagcaagatttgacggccaacaggaactgataacaatattaggaaatgtagcaaaaggaggacaatgtttaaaaggattaaataaatcaaatatcagtatattcaaggtaaaaactgacgtacttggtaagaaacacataatcaaaaaggaaggggacgaaccaaaactcaagttctga

SEQ ID NO: 5102 - RNA, 3366 nt, synthetic construct
  misc_feature 1..3366: note = Cas9 variant
  source 1..3366: mol_type = other RNA
atgagcgacctagtactagggttagacataggaataggaagcgtgggagtaggaatattaaacaaagtaacaggagaaataatacataaaaattcaagaatatttcccgcagcccaagcagaaaacaatcttgtaaggagaacaaacagacaaggaagaaggctaaccagacgcaagaaacatagaatagtacgtctaaatagactatttgaagaatcgggattaatcacagattttacaaaaattagcataaaccttaacccatatcaattgagagtaaaaggtctaacagacgaactatcaaacgaagaattatttatagcactaaagaatatggtaaaacatcgaggaatatcttacttagacgacgcgtccgacgacggaaactcctctgtaggagactatgcacaaatagtaaaagaaaactcaaaacaactagaaactaaaacgccaggacaaattcaactagaaaggtaccaaacatacggacaactacgaggagatttcacagtcgaaaaagatggcaagaaacatcgactaatcaatgtattcccaacatcggcatacaggtcagaggctttaaggatactgaaaacccaacaagagttcaatccacaaataaccgatgaatttataaaccgctacttggaaatactaacaggaaaaagaaaatattaccatggccctggcaatgaaaaatcacgaactgattatggtcgatacagaactaatggagaaacattagataacatatttggcatattgattggaaaatgcacattctacccagaagaatttagagcggcaaaagcctcatacaccgcacaagagttcaatctcctgaatgatttaaataacctgacagtaccaacagaaacaaagaaactctctaaagaacagaaaaaccaaataataaactacgtgaaaaatgaaaaagcaatgggaccagccaaattgttcaaatatatagcaaaattactatcatgtgacgtagcagacataaaaggctacagaatagacaaatcagggaaagcagaaatccacacgttcgaagcctatcgaaaaatgaaaacactcgaaactctagatattgaacaaatggacagagaaacgcttgataaattagcctatgttctaaccctaaacaccgaacgagaaggaatacaagaagcacttgaacacgaatttgcagatgggtcattctcacaaaaacaagtagacgagctagtccaatttagaaaagctaacagttcaatatttggaaaaggatggcataacttctccgtaaaactaatgatggaattaattcccgaactctatgaaacttcggaagaacaaatgaccatacttactagattgggaaaacagaaaaccacatcctctagcaacaaaacaaaatacattgatgaaaaattattaactgaagaaatatataatccagtggtagcaaaatcagttaggcaagctattaaaatagtaaatgcagctataaaagaatacggagactttgacaacattgtcatcgaaatggctagagaaacaaatgaagatgacgaaaagaaagcaattcagaaaatacaaaaagcaaacaaagatgaaaaagacgcagcaatgctaaaagcagcaaaccaatataacggaaaagctgaattaccacattcagtcttccacggacataaacaactagcgactaagatccgcctctggcaccaacaaggagaaagatgcctatacacaggcaaaaccatatcaatacacgacctaataaataatccaaaccaattcgaagtagaccacatcctaccattatccataacattcgacgattccctagcaaacaaagttctagtatacgcaacagcaaaccaagaaaaaggacaacgcaccccatatcaagccttagacagcatggatgacgcatggtccttccgagaactaaaagcattcgtaagagaatccaagacattaagcaacaaaaagaaagaatatctactaacagaagaagatataagtaaattcgatgtccaaaagaaattcatagaaagaaacctcgtagatacaagatatgcatcacgagtagtattaaacgctctccaagaacactttagagcacacaaaatagacaccaaagtaagcgtagttcgggggcaattcacctctcaattaagaaggcattggggaatcgagaaaacacgagatacataccaccatcatgcggtagacgccctaataatagctgctagttcgcaactaaacctttggaagaaacagaaaaacaccctagtatcatactcagaagaccaattactagatattgaaacaggtgaactcataagcgatgatgaatacaaagaatccgttttcaaagcaccctaccaacacttcgttgatacactaaaaagcaaagagttcgaagattctatcctcttctcataccaagtcgactctaaattcaatcgcaaaatatcagacgcaacaatttacgctacaagacaagccaaagtaggaaaagacaagaaagacgaaacatatgttttaggtaaaattaaagacatttatactcaagatggctacgatgccttcatgaaaatatataagaaagacaaatcgaaatttttaatgtacagacacgacccccaaacatttgaaaaagtaatagaaccgatactagaaaactaccctaacaaagaaatgaacgaaaaaggaaaagaagtcccctgcaacccatttttaaaatataaagaagaacacggctatataaggaaatattcaaagaaaggtaatggcccagaaataaaatcattaaaatattacgactcaaaactgggaaaccatatagacataacacccaaaaactctaacaacaaagtcgtactacaatcagtatcaccctggagagctgatgtatattttaacaaaacaactggaaaatatgaaatcttaggcttaaaatatgcagatttacaatttgaaaaaggtaccgggacctataaaatctcacaagaaaaatacaacgatattaaaaagaaagaaggagtcgatagtgactcagaatttaaatttactttatacaaaaacgatctactattagtaaaagacacagaaaccaaagaacaacaactatttagattcttatcaagaactatgcccaaaaagaaacactatgtcgaattaaaaccatatgacaaacagaaatttgaaggaggcgaagcgctaataaaagttctagggaacgtagcaaactcaggccaatgtattaagggcttagcaaaatcaaacatctctatttataaagtaagaactgacgtgctcggaaatcaacacataatcaaaaacgaaggagacaaaccaaaactagacttctga

SEQ ID NO: 5103 - RNA, 3366 nt, synthetic construct
  misc_feature 1..3366: note = Cas9 variant
  source 1..3366: mol_type = other RNA
atgtcagacctagttctaggactagatataggaataggaagcgtcggcgtagggatattaaacaaagtaacaggtgaaataattcataaaaacagtcggatattcccggcagcccaagctgaaaacaaccttgttagaagaacaaataggcagggaagaagattaacacgaagaaagaaacacagaagagtgagactaaatagactattcgaagaatcaggattaataacagattttacaaaaataagtataaatcttaatccataccaactacgagtaaaaggcctaacagatgaactcagcaatgaagaattgttcatagcattaaagaacatggtaaaacatcgcggtatatcttatttagacgacgcatcggacgatggtaacagttcgataggggattacgcccaaatagttaaagaaaactcaaagcaactagagacaaaaacacctggacaaatacaactcgaaagatatcagacatatggacaactaagaggagatttcacagtagaaaaagacggtaagaaacacagattaataaacgtattcccgacatcagcatatagaagcgaggcactaagaatcttgcaaactcaacaagaatttaatccgcaaataaccgacgaatttatcaaccgatatttagagatcttaaccggaaaacgaaaatactaccacggaccaggcaatgaaaaatcgcgaacagattacggtcgttacagaacaagtggggaaactctggacaacatattcggaatattgataggtaaatgtacattttaccccgacgagttcagagcagctaaagcaagctatactgcacaagagtttaacctcctaaacgacctaaataatctaacggttcctactgaaacaaagaaactttccaaagaacagaaaaaccaaatcataaactatgtgaaaaacgaaaaagccatgggaccagccaaactattcaaatatattgcaaaactattaagctgtgatgtggcagacattaaaggctacagaatcgacaaatctggaaaggcagaaatacatacgttcgaagcatatcgaaaaatgaaaacccttgaaacactagatatagagcaaatggatagagaaaccttagacaaacttgcttatgtactaaccttaaacaccgaaagagaaggaatacaagaggccttagaacatgagttcgcagatggatcattcagccaaaaacaagttgacgagctagtgcaatttaggaaagcaaattcttcaattttcggaaaaggatggcacaactttagtgtaaaactaatgatggaactgataccagaattatatgaaacatcagaagaacaaatgacaatactaactaggcttgggaaacagaaaacaaccagtagttcaaacaaaactaagtacattgacgaaaaattattaacggaagaaatatacaaccccgtagtggcgaaatcagtaagacaagcaatcaaaatcgtaaatgcagctattaaagaatacggagattttgataatattgtgatagaaatggcacgagaaacaaatgaagacgatgaaaagaaagcaatacagaaaatacaaaaagcaaacaaagacgaaaaagacgctgcaatgctaaaagcagcaaatcaatacaatggaaaagcagaattaccccactcagtattccatgggcataaacaactcgctacaaaaataagactatggcaccaacaaggtgaaagatgcttatacactggcaaaaccatctcaattcacgatctaataaataattccaaccaattcgaggtagatcatatactccccctatctataacttttgatgactcattagcaaataaagtattagtatatgcaacagcaaatcaagaaaaaggacaaagaacaccataccaagcactagatagcatggatgatgcatggtcgttcagagagttaaaggcctttgtaagggaaagcaaaacattatctaacaagaagaaagaatacttgttaacagaagaggacatttcaaaatttgacgtccgcaagaaatttatagaacgcaatttagtcgacacacgatatgcctcccgagtagtactaaatgctttacaagaacacttccgagcacacaaaatcgacaccaaagtaagcgtagtaagaggtcaattcaccagccaactcagaagacactggggaatagagaaaacaagagacacataccatcaccatgcagttgacgcattaataattgctgcatcatctcaacttaatctatggaagaaacagaaaaatacgttagtatcctacagtgaagatcaactcctcgacatcgaaacaggcgaattaattagcgatgacgaatacaaagaaagcgtatttaaagcgccttaccaacacttcgtagacacattaaaatctaaagagttcgaagacagcatactattcagttatcaagtagacagtaaatttaatagaaaaatatcagacgcaacaatatatgccacaagacaagcaaaagtgggtaaagataaagccgatgaaacatacgtactaggaaaaataaaggacatatatacccaagacggatatgacgcatttatgaaaatatataagaaagataaaagcaaattcctcatgtatagacacgatccccaaaccttcgaaaaagtcatagaacccatacttgaaaactaccctaacaaacaaattaacgaaaaagggaaagaagtaccatgtaacccattcttaaaatataaagaagaacacggctacataagaaaatattcaaagaaaggaaatggccccgaaatcaaatcgctcaaatactatgactcaaaattagggaaccacatagatataacacctaaagatagtaataacaaagtcgtactacaatcagtcagcccttggagggcagatgtatatttcaacaaaacaacaggaaaatacgaaatactagggctaaaatacgccgatctccaattcgaaaaaggaaccgggacatataaaataagtcaagaaaaatacaatgatatcaaaaagaaagaaggggtagacagcgatagcgagttcaaatttacattatacaaaaacgacctcttattagtcaaagatactgaaactaaagaacaacaactattcagattccttagtagaacaatgccaaaacaaaaacactacgtcgaactaaaaccatacgataaacaaaaattcgaaggaggcgaagccttaataaaagttctaggtaatgtcgctaacagtggacagtgcaagaaaggactaggaaaatctaacataagtatctacaaagtaagaaccgatgtattaggtaaccaacatataattaaaaatgaaggagataaaccaaaattagacttttga

SEQ ID NO: 5104 - RNA, 3366 nt, synthetic construct
  misc_feature 1..3366: note = Cas9 variant
  source 1..3366: mol_type = other RNA
atgagcgacctagtattagggcttgacataggaataggatcagtaggagtcggaatactcaacaaagttacaggagaaataatacacaaaaactcgaggatatttccagccgcccaagcagaaaacaacctcgttagacggacgaacagacaaggaagaagactaacgcgaagaaagaaacaccgcagagtacgactaaaccgacttttcgaagaatccggacttataacagatttcacaaaaatatcaataaatctgaatccatatcaattacgagtaaaagggttaacagatgaactatcaaatgaagaactatttatagccctcaaaaacatggtaaaacatcgaggtatatcatatttagacgacgcatctgatgatggtaacagctcagtcggagactatgcacaaatagtcaaagaaaactcaaaacaattagaaacaaaaacaccaggacaaatacaactagaaagatatcaaacatatggtcaattaagaggcgacttcactgtcgaaaaagatggtaagaaacaccgtttaatcaatgtatttccaacaagcgcatatcgatccgaagcactaagaatactccaaactcaacaagagttcaacccccaaattactgacgagttcgtaaatagatacctagaaattctaacaggaaaaagaaaatattaccatgggccaggaaatgaaaaatcacgaacggactatggaagatataggacaaacggagaaacactcgataacatttttggaatattaatcgggaaatgcacattttatccagaagaatttagagcagctaaagcaagttataccgcacaagagttcaacttacttaacgatctgaataacttaacagtacccactgaaaccaagaaattatcaaaagaacagaaaaatcaaattatcaactatgtcaaaaatgaaaaagcgatgggaccagccaaactatttaaatacatagctaaactcctttcatgcgatgtagcagatataaaaggataccgaatagacaaatccggaaaagcagaaattcacacattcgaagcatacaggaaaatgaaaacattagaaaccctagacatagaacaaatggatcgtgaaacattagacaaactagcatacgtactaacacttaacacagaaagagaaggaatacaagaagcattggaacacgagttcgctgacggtagcttttctcaaaaacaggtagacgaattagtacaattcagaaaagcaaactcatcaatcttcggaaaaggatggcataatttcagtgtgaaactgatgatggaacttattcctgaactatatgaaacgagcgaagaacaaatgacgatactaaaacgattaggaaaacagaaaacaactagcagtagtaacaaaacgaaatatatagatgaaaaactacttacagaagaaatatataatccagtcgttgcgaaatcaattagacaagcaataaaaattgtaaacgcagcaataaaagaatacggagattttgacaatatcgtaatcgaaatggcacgagaaacaaatgaagatgatgaaaagaaagcgattcagaaaatacaaaaagcgaacaaagacgaaaaagatgctgctatgctgaaagcagcgaaccaatataacggaaaagctgaactacctcactccgtattccatggtcacaaacaactagcaacaaaaattagactgtggcaccaacaaggagaacgttgcttgtacaccggaaaaacaataagcatacacgacctaataaacaatccaaatcaatttgaagtagatcacatattacccctatcaattacttttgacgattccctagcaaataaagtgctagtatacgctactgcaaatcaagaaaaaggacaacgaacgccatatcaagccctagattcaatggacgacgcatggtcattcagagagctaaaagcatttgtaagagaaagtaaaacactttcaaacaaaaagaaagaatatttattaaccgaagaggacatctctaaattcgatgtacgcaagaaatttatagaaagaaatctagtagacacaagatatgcatcacgagtagtcctaaatgctctccaagaacattttagagcacataaaatagacactaaagtatcagtcgtaagaggacaattcacatcacaattaaggcgacattggggaattgagaaaacaagagacacctatcaccaccatgctgtcgacgcccttataatcgcagctagttctcaattaaacttatggaagaaacagaaaaataccctagtaagctatagcgaagaccaacttttagacatcgaaacaggcgaattaatctctgacgatgaatataaagaatcagttttcaaagccccctaccaacatttcgtagatacattaaaatcaaaagagttcgaagacagcattctattttcttatcaagtagattccaaatttaatagaaaaatctcagacgcaacaatatacgcaacaagacaagccaaagtcggcaaagacaagaaagacgaaacttatgtactaggaaaaattaaagatatatacacacaagacgggtacgacgcctttatgaaaatatacaagaaagataaatcaaaatttttaatgtaccgacatgatccacaaacatttgaaaaagtgattgaaccaatattagaaaactacccgaacaaagaaatgaatgaaaaaggaaaagaagtcccatgcaacccattcctcaaatacaaagaggaacatggatatatacggaaatatagtaagaaaggaaacgatcctgaaataaaaagtctaaaatattacgacagtaaactagggaatcacattgatataactcccaaagattcaaataataaagtagtattgcaatccgtcagtccttggcgcgcagatgtttatttcaacaaaacgacaggaaaatacgaaatacttggacttaaatatgcagatctacaattcgaaaagggcacaggaacttataaaataagtcaagaaaaatataacgacataaagaagaaagagggagtagatagtgattcggagttcaaattcactctatacaaaaatgatctccttcttgtaaaagacaccgaaacaaaagaacaacaattattcaggttcctaagccgtacaatgcccaagcaaaaacactacgtagaactaaaaccatacgacaagcaaaaattcgaaggcggtgaagccttaatcaaagtattaggtaacgtcgcaaacagtggccaatgcaagaaaggactaggaaaatcaaatataagcatatataaagtacgtaccgacgtccttggaaaccagcatataattaaaaatgaaggcgacaaaccaaaactagacttctga

SEQ ID NO: 5105 - RNA, 3366 nt, synthetic construct
  misc_feature 1..3366: note = Cas9 variant
  source 1..3366: mol_type = other RNA
atgaatggacttgtactaggattagatataggaatagcatcagtaggggtcggaatcttagaaaaaaatagcggtaaaatcatacacgccaattccaggttattccctgctgctacagccgacaacaatgtagagagaagaaaaaatagacaggcaagaagacttcacaggagaaaaaaacacagaggagtacgattccaagacctattcgaagactatggattgttaactgacttttcaaaagtaagtataaatctaaacccctacagactacgtgtcgacggattaaaccagcaattaacaaacgaagaactgtttatcgcattaaaaaatatagtaaagagaagaggaatatcctacttagatgacgcatccgaagatggaggaactgtgtcatcagactatggaaaagcagtagaagagaaccggaaactcctcgcagagcaaacgcctggccaaatacaacttgaaagattcgaaaaatacggtcaagtacggggggatttcacagtagttgaaaacggagaaaaaagacgactaataaatgtatttagcactagtgcatataggaaagaagcagagagaatactcagaaaacaacaagaattcaacagtaaaattactgatgaatttattgaggactgccttaaaatattaactggaaaacgaaaatattaccatggtcccggaaacgaaaaaagcagaaccgactacggaagatttcgaactgacggaacaaccttagataacatctttggaatactcattggtaagtgtacgttctacccagatgaatatagagctagcaaagcctcctacaccgcacaggaattcaatctattaaacgacttaaacaacctaactgtaccaactgaaacgaaaaaactatcagaagaacaaaaaaaagtaatcgttgaatacgctaaagaagcaaaaacactaggagcgagtacactattaaaatacattgcaaaaatgatcgacgcctcagtagatcagatccgaggataccgcgtcgacgtaaacaacaaaccagaaatacatacgttcgaagcctacagaaaaatgcaatcgttggagacaatatcagtaggagaactatcccgaaacgttctcgatgagttagctcatattttaacactaaataccgaaagagagggtatagaagaagctattaacacgaaattaaaagacagcttcagccaagatcaagtcctggaattagttcaattccgaaaaaacaactcatcactcttttcaaaaggatggcacaacttctcactaaaactcatgatggaattaataccagaactatacgaaacaagtgaagaacaaatgaccatactaacaagactaggaaaacaaaaaagcaaagaaataagcaaacgaacaaaatatattgatgagaaggaattaacggaagaaatatacaatcccgtagtagcaaaatcagttagacaagcaataaaaataatcaacgaagccacaaaaaaacacggtatatttgataatatagtgatagaaatggctcgggaaaataatgaagaggatgcaaaaaaagattatataaaaagacagaaagcaaaccaagatgaaaaaaacgctgctatggaaaaagcagcttttcaatataatggcaaaaaggaacttcccgatagcatatttcatgggcaaaaagaacttgcaacaaaaatcagattatggcatcaacaaggagaaaaatgtctatatacaggaaagaacatcccaatcagtgacttaatacacaatcagtacaaatatgaaatcgaccatattcttccactatccctatcgttcgacgacagcttaagcaacaaggtcctagtcttagcaactgccaatcaagaaaaaggacaaagaaccccatttcaagcactagatagtatggatgatgcatggtcttacagggaattcaaaagttatgtaaaagaaagtaagttacttggtaataaaaaaaaagaatatttactaacagaagaagacataagtaaaatagaagttaagcaaaaatttatagaacgaaacttgatagacacacgctacagctcgagagtagttcttaatgcactgcaagacttttacaaagcgcataaatttgatacaacaattagtgtagtcagaggacaatttacaagccaactacgaagaaaatggggtttagaaaaatcaagagaaacatatcatcatcacgccgtcgatgctctcataattgcagcgtcatcacaactcagactctggaaaaaacaaaacaacccactaatagcatataaagaaggccaatttgtagacagcgagacaggggaaataatatcattatcagacgacgaatacaaggaactagtatttaaagcaccatatgatcactttgtagacacattaagttcgaaaacatttgaagactccatactattctcgtaccaagttgattctaaatttaatcgaaaaatatcagacgcaaccatatacgcgacacgaaaagcaaaattagacaaagaaaaaagcgaggaaacatacgttctaggcaaaataaaagacatatacagccaggcagggtatgacgcatttataaaaatatataataaagacaaaagcaaattcttaatgtatcacaaagacccccaaacattcgaaaaagtcatagaagaaattctcagaacatacccatctaaagagttaaatgacaaaaacaaagaaataccttgtaatccattcgaaaagtacagacaagaaaacggacccatcaggaaatattcaaaaaaatcaaatggccccgaaatcaaatccctcaaatactatgataataaattaggaaaccacatagatataacacctgaaagttcagacaatcaagtagtactacaatcattaaaaccatggagaacagatgtctatttcaaccaccaaacaaaaaaatatgaacttatgggcttaaagtattcagacttatcttttgagaaggggagtggtaaatatagcatctcaaaccaaaaatacaattccataaaacgcatcgaaggcatagatgaacagtccgaattcaagtttacactatataaaaatgatttaatattaatcaaagacagcgaaaataatgaacaaaaactcttccgatttaatagccgtaacgatactgcaaaacattacatcgaactaaaaccttacgataaagcaaaattcgacggcgaacaagaattaattacaattttaggaaacgtagcgaaaggaggccggtgcttaaaggggttaaacaaatcaaacatatccatctttaaagtaaaaacagacgtcctgggaaaaaaacatataataaaaaaagagggagacgaaccaaagctcaaattttga

SEQ ID NO: 5106 - RNA, 3366 nt, synthetic construct
  misc_feature 1..3366: note = Cas9 variant
  source 1..3366: mol_type = other RNA
atgaacggactagtgttaggtcttgacataggaatcgcctctgtaggtgtcggtattcttaacaaagacacaggggaaatcatacacaccaatagccgtatttttccggcagcaacagcagataacaatgtcgaacgacgaaactcaagacaagacagaagactaaacagaaggaaaaaacatagaggagtccgactacatgatcttttcgaagactatgatctgctcaccgatttttcaaaagtatcaattaaccttaatccctatcgactacgagtacaaggacttgataattcgctgacaaccgaagaacttttcatcgcactaaaaaatatagtgaaaagacgaggaatctcatatttagacgacgctagcgaggacggtggagtagtaagctcagattacggcaaagcagtagaggaaaacagaaaacttttagcagaacaaacacctggtcagatacaactagaaagatttaagaaatatggtcaagttagaggcgatttcacagttgtagaaaacggagagaaacgacgactaatcaacgtattctcaaccagtgcataccgcaaagaagcagaaagaatcctaagaaagcaacaagaattcaataatcaaatcacagataaattcattgaggactacctaaagattttgacggaaaaaaggaaatactaccacgggcccggcaatgaaaaatcaagaacggattacggcagatttcgtacagacgggaccacattagacaatatcttcgggatcctaataggaaagtgcacattttatccgaacgagtatagagcaagtaaagcatcctacacagcacaagaattcaacctattaaatgacctaaacaaccttacggtaccaacagaaaccaagaaactatcagaagaacaaaaaaaaacaatagtggaatatgcaaagagcgccaaaacgctaggagcatcaaccctactcaaatacattgctaaaatgatcgacgcatccgtagatcaaataaggggataccgagtcgacgtaaataacaaaccagaaatgcacacctttgaagtttaccgcaaaatgcaatctttggaaactataagtgtatgggagttatcacgtaatatactagacgaattagcacatatattaacactaaacaccgaaagagaaggcatagaagaagcaataaacacaaaacttatggacgtcttttcacaagatcaagtattagagttggtacaatttagaaaaaacaactcaagccttttcagtaaaggatggcataacttcagcagaaaactaatgatggagctcataccagaattatacgaaacaagcgaagaacaaatgacaattttaacaagacttggcaaacaaaaatccaaagagacatcaaagagaacgaaatatatagacgaaaaagaagtaacagaagaaatctacaaccctgtagtagctaaatcagtaagacaagctataaaaattataaacgaagcaacaaaaaaatacggaattttcgataacattgtcatagaaatggcccgagaaaacaacgaagaagatgcaaaaaaagactacataaaaagacaaaaagcaaatcaagatgaaaaaaacgttgcaatagaaaaagcagcatttcaatataacggcaaaaaagaactacccgattcaatcttccatggacacaaagaactagctacaaaaataaggctttggcaccaacaaggagaaaaatgcttatatacaggaaaaaacatcccaatatcagacctaattcataatcaatataagtacgaaatagatcacatactacccctatcgttaagttttgacgattcactatccaataaagtattagtattagcaaccgcaaatcaagaaaaaggacagagaactccatttcaagcattagatagtatggacgacgcctggagctatagagaattcaaatcatatgtaaaagacagtaaactattaggcaacaaaaaaaaagactacctcctaacagaagaagacatcagtaaaatcgaagtaaaacaaaaattcattgaaagaaacttagtagatacacgttattcatccagagtagtactgaatacactacaagacttctacaaagcacataaatttgatacgacaatcagcgttgtaaggggtcaattcacttcacagttaagacgcaaatggggcctcgaaaaatccagagaaacttatcaccatcatgccgtagatgcattgataattgcagcaagcagccaattaaggttatggaaaaaacaagccaaccctttgatttcctacaaagaggatcaattcgtagacagtgaaacaggagaaataataagcctaactgatgacaagtataaagaactagtattcaaagcaccatacgcacactttgtcgacactctgtcctcaaaaaaattcgaagattcaatcctcttctcttatcaggtagactcgaaatataatagaaaaatttctgatgctacaatatatgcaacaagaaaagtcaaactagacaaagataaaagcgaagaaacttacgtacttggcaaaataaaagatatttatagtcaagctggatatgacgcgttcattaaaatatacaataaagataaatcaaaattcctaatgtatcacaaagacccacaaacttttgagaaagtaatagaagaaatcctgcgaatatatccctcaaaagagttcaacgaaaaaaacaaagaagtaccgtgtaacccgttcgaaaaatacagacaagaaaacggaccaatatgtaaatacagcaaaaaagggaatggaccagaaataaaaagcttaaaatattacgataaaaacattccagagtcatttatagacataacaccatcaaattcaaagaataaagttatactacgacaactcaacccttggcgaacagacgtttacttcaatcaccaaactgaaaaatacgaattactaggactcaaatatgcagacctacaatttgaaaagaaaacagaaacatatagtataaccatcgataaatataatgaaattaaagaaaaagaaggagtaggagaacactctgaattcaaatttacactatacaaaaacgacttactactcataaaagacatggaaataaaagaagaacaaatatttcgattccttagtagaacaatgccaaacaaaaaacattacgtcgaactgaaaccttattacaagggtaacttcgaaggcaaagaaagaataaaagtcttcaatacaacaagtaacggaagatgcttgaaagggttaggcaaaaaaggcctatccatatataaaattaaaacggacgttcttggaaataaacatttcataaagaaagagggagaaaaaccaaaacttaaattctga

SEQ ID NO: 5107 - RNA, 3366 nt, synthetic construct
  misc_feature 1..3366: note = Cas9 variant
  source 1..3366: mol_type = other RNA
atggatagaacagaagtcaacatcggattcgacataggtatctcaagcgtaggatggtcagtcgtagcaactaaatcaggaaggatcttagaaagcggagtgtcactgttctcaggagctagtgcagctaaaaacgaagaacgaagaaacttcaggcaaagcaggagattacttaggagacgaaagaacagaatatcagatttaaagaaatatttaaaagagcaaagttttacatataacggtgaattgctaaacgaaaacccgtacgaaattcgagtaaaaggactcacagaaaaactatcaaaagaagaaattgcactagcattacttcacatagtcaaaaggagaggagtatcctatgatctgggcgacattgaagaggaaggaacaacagggtcatacaaagaaggagtaaagaaaaatcaaaaattactgaaagagaaaacaccggcagaaattcaattccaaagattaaagaaattccacaaagtcagaggacaaatagcaatagacgaaaatgatgtcctcttgaatgtattccctaaccacgcatacgtggacgaagcccaacaaatactgtacacacaacaagaattttatccagaaatcaatgaaacattcataaaccaagttacagatttcatctcaagaaaaagggactacttcatagggccaggctcggagaaaagtcgaactgattacggaatttatagaacagacggaacaaccctacaaaatttattcagcatcctaataggaaaagacaaaatctttcccgacgaatttagagctgccgggaatagttatacagcccaagtatataatctactcaatgacctaaacaacctagctattgatgacacagaaacaggaaaattaaccaaacaacaaaaagagaaaataataatggaattaaaaactacagaaaaatcagtgaatatgatgaaactcatagcgaaaacagccggcgtaacagtcgaacaaatcagcagatatcgaataaaccgggacggtaaaagtgaaatacacaacatggcagtctacagaaaaatcagaaaagtattcttagaactaggctacgaaatcaatgaatggccaagtcagctacttgacgaattgggagacgctttaagcctaaacactgaaaacggagaaatcagaagaatattaacagataacttagccaacaaatacaaaattttagaccaacagctcattaacttaattatagaaaacaaaaacgcattcaccttaagcacaaaccaaaaatggcacagattttcatacaaaacaatgaaaatactaataccagaactactagaaacaaacaaagaacaaatgacgatactaacagaaatgggacttatgaagaaagaccagagaaactatgtagggaaaaataaaatagattcagaagccctgctagaaaatctgtacaatccggtcgttcggaaatccactagacaaaccatgaaattatttaacacactactaaagaaatacccaaatattgcatatgtcgttatagaaatgcccagagaagacgacgaagataaagcaagaagagactatgttaaatttcaaaaagacaacgaaaaagaaaaagatgcagccctgaaaaactttattatggaatccggaaaatcagaagcagaagttatagcaaaataccgacaaagcaagaaatttagaagtaaagtccgattatggtatcaacaaatgggaagatgtctatattcaggaaaggcaatgcctgccgaaagagtatttagagacgaccactttaccgatatagaccatgtaataccactctcagtttcattcgacgatggaatgaacaataaagttttgtgcttagccgaaatgaacagacaaaaagataagcaaactccatatgctttcttcaacgcaggtcatggacagggattccaagcaatgaatgcaatgctaaagaataacaatagaatctcctcggcaaagaaaagaaacttattattcaccgaaaacttaaacgacctagaagtccgaaaaagatttatcgaacgtaatcttgtcgatacaagatacgcttcacgcgtcgtattgaatgaattacaacaattcgttaaagctaaacaattagatacaaaagtaaccgtaataagaggaaaattcacatcaaaactgagagaaaaatggaatataaataaaagtcgagacacccaccaccatcacgcagtcgacgctgctgtcatagcagtgtcaccaatgttaaacttatgggaaaaaggagcctcaataataccaaacaaagtaggagaaaacgtaatcgacataaagactggagaaattatcacagaccatgattacgaagcagatgtatacgagcttccctacgcaaaatttctagaacaaataccaaaagtaaagaaagatataaaattcagacaccaagtagataaaaagaaaaatcgcaaagtatcagacgcaaccatttacacaactagaaaagcaaaagtcggaaaagacaaagaggaaacagattacgtcctgggaaccataaaagacatttattcactggaaggttacgtttccttcaagaaaatatacaacaaagataaagcaaaattcctgatggcaagaatagacccaaaaacctttgaaaaactagagaaaatagtagctgaatatccagaatcaattgaagttgtacaagataatggaaaagtagatgtccagaaaatatcaccatttgaattatacaggaaagacaatgggtttgtaactaaatttgcaaagaaaaacaacggccccgctgttaaatcgttaaaatactacgatagcaaactaggaagctctatagatgtaactccagataatgctaaaaataagaaagtaatcctacaatcattgaaaccatggcgaacagacgtctacttcaacgaagaaaaccaagaatacgaaataatgggtctaaaatattcagatctaaaatttggtaaaaacggaaaatacggagtaccaaaagtaagatatgaagaaattaaacaagaagaagaaatatcagaaggttccaaatttctattctcactgtaccgcggagacaggataaaggtcaccaacgaactaggagaaaaccttgatctattgttttcaagcagaacgctaccagcacaaaaagggtatgttgaattaaaaccaatcgataaaacaaagttcgatggtaaagaaaaggtctcattctacgggactgtaacccctaatggacaattcgtaaagaaattcgcaaagaaaggatacaaaattctcaaactcaacacagatgaattaggaaatacatatatagaaaacggagaaaaagagcccagcgacatacttgatatgtga

SEQ ID NO: 5108 - RNA, 3366 nt, synthetic construct
  misc_feature 1..3366: note = Cas9 variant
  source 1..3366: mol_type = other RNA
atgaacggattagtattaggattagacataggaataggaagcgtaggcgtcggcattctaaacaaagacacaggagaaattatccatgcgaactcaagaattttccctgctgctacagcagacaacaatgtagtaagaagatcaagtcgtcagggacggagattaaaccacagaaagaaacatcgaagtgtacgactaaaagatttatttgaatattatgatctactgacagacttctccaaagtcagtattaacctaaatccatatagactaagagtaaacggccttaatcaacaattaacgaatgaagaactttttatcgcactcaaaaacatagtcaaacgaaggggaatctcttatctcgacgacgcaagcgaagatggaggagcagtttcgtcagattatggcaaagcagtagaagaaaacagaaaacttctcgctgagcaaacaccaggccaaatacaattagagagatttgagaaatacggccaggttcgaggcgatttcacagtagtcgaaaatggagagaaaagaagactcataaatgtattcagcacaagtgcatataagaaagaagcagaaaggatattaagaaaacaacaagaatacaataatcaaataatggacgagttcatagcagattatttaactatactcaccggaaaaagaaaatattaccacggtccaggaaacgaaaaatccaggacagattatggacgtttcaggacagatggaaccacattagataatatatttggaatcctgatcggaaaatgcacattctacccagaaaaatacagagcaagtaaagcatcttacaccgcacaagagttcaacctactaaacgatctaaacaacttaacggtacccaccgaaaccaagaaattatccgaagaacaaaagaaaactatagtcgaatatgccaaatccgcaaaaacactcggtgcatcaactcttcttaaatacatagcaaaaatgatagatgcctcagttgatcaaatacgaggctacagagtagatgtcaaaaacaaaccagaaatgcacaccttcgaagtataccgaaaaatgcaatcactagaaacaatatcagtaggggaattttcaagagaagtattagacgaactagcacatgtactcacactaaacacagaaagagaaggaatagaagaagcaataaatacaaaactcagagatagcttttcgcaagaccaaattctagagctagtacagtttcggaaaaataattcaagcctattttcaaaaggatggcacaacttcagcttaaaactaatgatggaattaatacccgaactatacgaaacgtcagaagaacaaatggctatactaacaagactaggaaaacagaaattcaaagaaacatcaaaaaggaccaaatatatagacgaacaagaagtaacagaagaaatctataacccggtagtggcgaaatctgtcagacaagccattaaaataatcaatgaagcaacaaagaaatacggaatattcgacaatatagtgatagaaatggccagagaaaataacgaagaagaagcaaagaaagactatataaaacgacaaaaagcgaaccacgacgagaaaaatgcagccatggaaaaagcagcatttcaatacaacggtgaaaaagaactaccggatagtatatttcacggacataaagaactagcgaccaaagtacgactttggcatcaacaaggcgaaaaatgcctatatacaggcaaaaatatccctataagcgacctaatacacaatcagtataaatacgaaatcgatcatatcttgccactatctctttccttcgacgattcactatcaaataaagtccttgttctagcaacagcaaaccaagaaaaaggacaaagaacaccatttcaagcactagactcaatggatgatgcttggtcataccgcgagttcaaatcttacgttaaagacagtaaatccctcggaaataaaaagaaagactatttattaacagaagaagacatatccaaaatagaagtgaaacaaaaatttattgaaagaaacctagttgacacaaggtacagctcacgagtagtactaaatactcttcaagacttctacaaagcacacaaattcgacaccacaatatcagtagtacgaggacaatttacgagccagcttagaaggaaatggggactagaaaaatctagagaaacttaccatcaccacgcagttgacgcactaatcatagcagcgagtagtcaattacgactatggaagaaacaaaacaatcctctaatatcatataaagaaggccaatttgtagactcagaaacgggagaaatcatatcactaaccgacgacgaatataaagaactcgtattcaaagctccctacgaccatttcgtagacacactcagatcaaagaaatttgaagactcaatcctgttttcgtaccaagtagactcaaaatttaaccgaaaaatatcagacgcaacaatttatgcaacccgcaaaacaaaacttgacaaagacaaatctgaagaaacttatgtacttggaaagataaaagacatatacagccaatctggatacgatgcatttataaaaatatacaacaaagacaagtcaaaattccttatgtaccataaagacccacagacattcgaaaaagtaatagaagagatcctaagaacttacccctcaaaagagttcaatgagaaaaataaggaagtatcatgcaatccatttgaaaaatataaacaagaaaatggccccataagaaaatactccaagaaaggaaacggaccagaaataaaaagcctcaaatactacgataaaaatatccccgagagcttcataaatatcacaccatcaaactccaaaaacaaagtaatcttaaggcaactcaacccatggcgaactgacgtatacttcaaccatcaaacagaaaaatacgaactattgggtctaaaatacgctgatctacagttcgaaaagaaaacaggaacttactccataacgatagacaaatataacgaaattaaagaaaaagaaggtgtatcagaacacagcgaatttaaattcaccctatataaaaatgacctcctactgatcaaagacacagagattaaggaggaacaaatttttagatttttatcgcgaaccatgccaaatcaaaaacattacgtagaactaaaaccctattataaaggaaacttcgaaggaaaagaaagaataaaagtctttaacaccacatcaaacggtagatgccttaaaggtttacgaaagaaaggcctatctatatacaaaataaaaacagatgtactaggcaacaaacacttcataaagaaagaaggcgaaaaaccgaaattgaaattttga

SEQ ID NO: 5109 - RNA, 3366 nt, synthetic construct
  misc_feature 1..3366: note = Cas9 variant
  source 1..3366: mol_type = other RNA
atgagcgacttagtactaggacttgacataggtatcggatctgtaggagttggcatacttaacaaagtaaccggagaaataattcacaaaaactcgcgaatattccctgctgcccaagcagaaaataatttagtacgccgtacaaaccgacaaggtcgtagattaactcgaagaaagaaacataggatagtccgcctaaatcgcctgttcgaagaaagcgggctaataaccgacttcacaaaaatttcaattaacttaaacccatatcaattaagggtaaaaggccttactgatgaactatcaaacgaagaactatttatagcacttaaaaacatggtaaaacacagaggaatctcatacttagacgatgcatctgatgacggcaattcttccgttggagactatgcccaaattgtaaaagaaaacagcaaacaactagaaaccaaaacaccaggtcaaatacagctcgaaagataccaaacatacggacagttgagaggagactttacagtagaaaaagacggaaagaaacatagactaataaacgttttccccacatcggcgtatagatccgaagcattaagaatattacaaacacaacaagagttcaatccacaaataacagatgagttcatcaacagatatttggaaatattaacaggtaaaagaaaatactatcatggaccaggtaacgaaaaatcacgaacagactatggcagatatagaaccagcggagaaaccctagacaacatatttggaatcctcataggaaaatgcaccttctatcctgacgagttccgcgccgccaaagccagttatactgcacaagagttcaacctactaaatgacctaaacaacttaactgtaccaaccgaaaccaagaaactatcaaaagaacagaaaaatcaaataatcaattacgtgaaaaatgaaaaagcaatgggacccgccaaactattcaaatatatagctaaactcctgagttgcgatgtagccgatataaaagaatatagaatcgacaaatctggtaaagccgaaatacatactttcgaagcatatcgaaagatgaagacattagaaacccttgatattgaacaaatggacagagaaacgctagacaagttagcatacgtattaactttaaacaccgaacgagaaggtatacaagaagcattagaacacgaatttgccgacggctcttttagtcaaaaacaagtagatgagctagtacaattcagaaaagctaacagtagtatatttgggaaaggatggcacaatttcagtgttaaacttatgatggaacttatccccgaactatacgaaacctcagaagaacaaatgactatattaacaagactaggaaaacagaaaacaacaagctcatccaacaaaacaaagtatatagatgaaaaattactaacagaagaaatatataatcccgtagtggcaaaatctgtccgacaagctataaagatagtaaacgctgcaataaaagaatacggtgactttgacaacatagtcatcgaaatggctagagaaaccaatgaagacgatgaaaagaaagccatacagaaaatacaaaaagcaaataaagatgaaaaagatgcagcaatgctaaaagcagccaatcaatacaatggaaaagctgaattaccacactcagtcttccacggccataaacaattggcaacaaaaataagactatggcaccaacaaggcgaaagatgtctatacacgggaaaaacaattagtatacatgacctgataaacaatagtaatcaattcgaagttgaccatatcctcccgctgtcaattacgttcgatgatagtttagccaacaaggtattggtatatgctacagccaaccaagaaaagggccaaagaacaccatatcaagcgctagatagcatggacgacgcatggagcttcagagaactaaaggctttcgtacgggaatctaaaacactatcaaataaaaagaaagaatatctattaaccgaagaagacatatcaaaattcgacgtaagaaagaaatttatagaaagaaatctagtggatacaagatacgctagcagagtcgtcctaaatgcattacaggaacactttagagcacacaaaatagacacaaaagtctccgtagttagaggacaattcacaagccaactaaggagacactggggcatagagaaaacaagagacacataccatcatcacgccgtagacgcattaataattgctgcatcaatacaactcaatttgtggaagaaacagaaaaataccctagtctcctatagcgaagaccaactattagatatagaaacaggagaattaatatcagacgatgaatacaaagaaagtgttttcaaagccccatatcaacacttcgtagacactttaaaatcaaaagagttcgaagactcgatactattttcatatcaagtggacagtaaattcaatcgaaaaatatcagacgcaacgatctacgcaacacgccaagcaaaagtgggtaaagacaaagccgacgaaacttacgtattaggaaaaataaaagatatatacactcaagacggatatgatgcgtttatgaaaatttacaagaaagataaatctaaattcctgatgtaccgccatgacccgcaaacattcgaaaaagtaatcgaacccatattagaaaattatccaaataaacaaataaacgaaaaagggaaagaagtcccagtcaatccattcttaaaatataaagaggaacatggatatatacgaaaatactcaaagaaaggtaacggaccagaaatcaaatcgctcaaatattacgactccaaacttggaaaccatatagacataactcccaaagattctaacaacaaagtagtactacaatctgtctcaccatggcgagcagacgtctactttaacaaaacaacaggaaaatacgaaatacttggacttaaatacgcagacctacaattcgaaaaaggaacaggaacatataaaataagccaagaaaaatacaatgacattaaaaagaaagaaggagtagactcagattctgaatttaaattcacactatacaaaaacgacttgctactcgtcaaagacacagaaaccaaagaacaacaactattccgattcctatcaagaacaatgccaaaacaaaaacattacgtagaattaaaaccgtacgacaaacaaaaattcgaagggggagaggcactaatcaaagttctaggtaatgtcgccaattctggacaatgcaagaaaggactcggaaaaagcaacattagcatatacaaagtccgtacagatgtattaggtaatcaacacataattaaaaatgaaggagataaaccaaaattagacttttga

SEQ ID NO: 5110 - RNA, 3366 nt, synthetic construct
  misc_feature 1..3366: note = Cas9 variant
  source 1..3366: mol_type = other RNA
atgaacggtctagtcttaggactcgacataggaatagccagtgtaggagtcggaatattagagaaaaatagcggaaaaataatacacgcaaattctcgcctcttcccagcagcaacagcagacaataacgtagaacgtcggaaaaacagacaagctagaagattaaaccgaagaaagaaacataggggagtccgattccaagacctattcgaagactatggtctactaacagacttttcaaaagtgagcataaacttaaatccgtataggttaagagtagacggcctaaatcaacaattaacaaacgaagaactattcatcgctctgaaaaatattgtcaaacgtaggggaataagttatttagatgatgcatccgaagacggaggcgccgtatcatcagattacggtaaagctgtagaagaaaatcgaaaactactcgcagaacaaaccccaggacaaatacaactagaaagattcgaaaaatatggccaagtaaggggagattttacagtagtagaaaatggagaaaaatgccgccttatcaatgtcttcagtacttctgcttaccgaaaagaggcagagaaaatacttaggaaacaacaagagttcaacaaccaaataaccgacgaatttattgaagattacctaaaaatattaactggcaaacgtaaatactatcatggaccaggaaacgaaaaatcaaggacagattacggaagatttcggacagatggaacaaccctcgacaacatattcggcgtactaataggtaaatgtacattttatccaaatgaatacagagccagcaaatcgtcatacaccgcccaagagttcaacctacttaatgacctcaataatctcaccgtaccaacggaaacaaagaaattaagtgaagaacaaaagaaagtaatagttgaatacgctaaagaagccaaaacattaggagcgtcaacactgttaaaatacatagttaaaatgatagacgcttctgtcgatcaaatttctggatatagggtagatgtaaacaacaaacccgaaatgcacaccttcgaagtctataggaaaatgcaatctctagaaactatcagcgtaggagaattatcaagaaacgtattagacgaactagcacatatactaacactaaatacagaaagggaaggcatcgaagaagcaataaattctaaattaatgggagtatttagccaagaccaagttttagaattagtacaattccgcaaaaacaactcatcactctttagcaaaggttggcataacttcagcctaaaattaatgatggaattaatacctgaactttacgaaacatcagaagaacaaatgaccatactaactagactaggcaaacaaaagagtaaagaaacaagtaaaagaacaaaatacatagatgaaaaagaattaaccgaagaaatatataacccggtagttgctaaaagtgtcagacaagcaatcaaaatcataaacgaagcaactaagaaacacggaatatttgataacatagtcatagaaatggcgagagaaaacaacgaagaagacgcaaagaaagactacataaaacgacaaaaagcaaaccaagacgagaaaaacgcggcgatggaaaaagcagcattccaatataacggcaagaaagaactaccaggcaacatatttaacggccacaaagaactagctacaaaaatacgcttgtggcatcaacaaggggaaaaatgtttgtacacaggaaaaacaataccaataagcgacttaatccacaaccaatacaaatatgaaatcgaccacatcctacccctttcacttagctttgacgactcattatcaaataaagtcttagttcatgcaacagcaaatcaagaaaaaggacaaagaactccatttcaagcactagactcaatggacgacgcctggagctacagagaatttaaaagttatgtaaaagacttaaaatcgttatccaacaaaaagaaagattacctacttaccgaggaagacatctcaaaaatcgaagtaaaacaaaaatttatagaaagaaatctagttgatacaagatacagctctagagttgtgctgaacgctctacaagacttctacaaaagccaccaattcgacacaaccataagcgtcgtaaggggccaatttacatcacaactcagaagaaaatggggactggagaaaagtagggaaacatatcatcatcacgctgttgatgcattaatcatcgcagcatcctcacaactgaggttatggaagaaacaaaataatcccttaataacatacaaagaaggccaatttgtcgattcccaaacaggagaaattattagcttaacagacgatgaatacaaagaactcgtatttaaagcaccttatgaccatttcgtagacacactacactctaaaacatttgaagatggaatattatttagctaccaagtagactcaaaatacaacagaaaaatctcggacgctacaatctacgcaacaagaaaagccaaactagacaaagataaaagtgaagaaacttacgtactaggaaaaataaaagacatatactcccaagctggatacgatgcctttataaaaatatacaacaaagacaaaagaaaattccttatgtaccataaagacccacaaactttcgaaaaagttatcgaagaaatcttaagaacatatccatcaaaagagagaaacgataaaaataaagaagtgccctgtaatccatttgaaaaatatcgtcaagaaaacggccccatcagaaaatactcaaagaaaggaaatgggcccgaaataaaatgcctaaaatattatgacaacaaactcggcaattacatcgatatatcaccagacggatctgataaccaagtagtcctacaatcactcaaaccctggaggaccgacgtctactttaaccatcaaacaaaagaatacgagctgatgggccttaagtattctgatttaagtttcgaaaaagggagcggcaaatacagcattagcaatgaaaaatacaatagcataaaaaggatagagggggtcaatgaacaatctgaatttaaatttactctatacaaaaacgatctaatcttaataaaagattccgaaaacaacgaacaaaagctattcagattcaactcgagaaatgacactgctaaacactacgtagaactgaaaccgtacgataaagcaagattcgatggacaacaagaactaataacaatcctcggtaacgtggcaaaaggaggtcaatgtttaaaaggattaaacaaatcaaacatatctatttttaaagtaaagacggatgtattaggaaagaaacacatcatcaagaaagagggggacgaacccaaacttaaattctga

SEQ ID NO: 5111 - RNA, 3366 nt, synthetic construct
  misc_feature 1..3366: note = Cas9 variant
  source 1..3366: mol_type = other RNA
atggcagataaaaccttaggagcactaacattcggatttgatataggtatagcatcagtcggctggtgtgtgttaggagaaaacagaatcgttgacctcggagttcgagcttttgataaagctgaaacggcaaaagaaggtgaaagcctcaatctcgctagaagaaccgcacgccttatgagacgcagactcagaagacgagcatggagactaacgaaactagcacgactacttaaaagagaaggattaattgcagatgcattccaaatgcatcaaccaagtgcgacatctccgtggaagttaagagtagaagcgctggaccgccgcctcacagacgacgaatgggcaagagttatatatcatctctgtaaacaccgtggttttcactggataagtcgtgcagaagaaaagaaagcagaaggagatgcaaaaggtgaatcaggtcgtgtaaagaaaggattgagtgatacacaaagacgaatgggagaaaaaggatatcggtccgcagctgaaatggtacttgctgaatttcctgaagctcaaaggaacaaacaaggagattatggcaaagcattaagcagagtactattaagtgaagaattagcattattgtttagaagacaaagagaactaggtcacactcatgcatctaaagaactagaagcagcgatcttaggaaatggagatcgaaaaggaggtttgttttgggctcaaaaacctccactagcaggagcagatcttttaaaaatgcttggcaaatgtactttcgaaaaagacgaatacagagcaccaaaagcatcttttaccgcagaaagacacgtatggttgaccaggctcaataatttaagagtcgtagtagatggtaccacgagaccattgacagaagacgaaagacgggtagcactaccattaccatatggctatgcggacgctaaattaacatataaacaattaagagctgcattaagcaaagctggtttaagtaattttagtttcgcgggaattgctgatgacaaagaaaaagatacgctaacaaaattaccagcatgggaaacgctatccaaaacactaaaaggaaaaggcttagaaactgaatgggaaggaatggcgggtgcagctacgggaggagacccgactttacttgatgaaataagcagagtactctcagtatataaagatggcgacgaagtggacgttgaattaagaaaattacctctacccggaggagagaaaatggttgaaacattaagcgaaattagctttgacaaatttcacgcattatcgttaaaagcactacgaaaaatagtaccacatatggaaactggactcaggtatgatgaagcctgcgcagcggcaggctatcatcatagccaactccatgaagcaggcgcgggtggacaaaaatatttaccacctttctatacacgacgggataaagacgggagaatggtattcgacgaggaactagacgtacctagaaacccagtagtattaagagcattgaaccaagcaagaaaggtattgaacgccctagtaagagcatatggctctccatcagcagtgcacatagaaatggcaagggatttaagtaaaccgctagtgggacatcctaccccgaatggaggctatatagaaggtagaagagatatagaaaaactccagaaagaatatagagaaagaaatgaaaaagataaagccgcattcgcagcagaacatggtatagcagcaaaatcaagagagttcgaaaagtttcaactttatagagaacaacaaggcaaatgtgcctatagtttgaaacccctggacctacatcgagtattacatgacataggttatgctgaagttgaccacgccttaccctattcacgctcatacgacgatgggaaaaataacaaagtacttgtcttgacagaagaaaatagaaacaaagggaatcggacagcatacgaatatctatgtgcttttccaggtggggaaaatggagagagatggagaaatttcgtcgcatatgtagaaagtaacaaaagttaccgactagccaaaagaacaagattattaagaaaagacttcggaggaaaagccgcagaggaatttcgagaaagaaacttaaatgatacgagatatatatgtaaattctttaaaaattttgtagagaggtttttacaactaaaggtgggagcagatggaacagcagcaaaaagatgcgtagtactctcaggacaaacaacagcatttttaagagctaggtggggtctattaaaagtcaggggtgctagtgatcgacatcatgcacttgatgcagccgtagttgccgcttgttcacatggaatggtaaaaagattagcagactacagcagaactaaggaactcgcaaaagtacgagatggattcccggatccagaaaccggagaaatagtagacccagcgatgtttcaacaactacatgcacactttcctgacccatggccccatttcagaggggaactagaagcacgactacagctagatgattcggcagaattgcgcgcacaacttgaaatgtttggaacatatccagcggaagcactagaaacattaagaccactatttgtttcacgtgcaccacaaagaagaaatggcggagcagcacacaaagaaactatatacgcacaacctgaacgcctcaaggaacaaggaggggtaacacaaaaagtatccctagcctccctaaaaccaacagatattgataaattgatcgatccacaccgaaacgaaaaattgtacgcggcaatacgcgcgagactagaagctcatggtggaaaatcagataaagcattccctgctgataatccactacgaaaaccggacagagatggtaatcctaccggtccaatagtccgcgctgtaacaatggtaatagacaagctgtcgggtatacaaattagaggaggaattgcaaagaatgacacgatgctacgagttgacgtatttcgacacaagaaagatggcaaatttcatttagtaccactctacgtacaccacgctgtggctcaagaattaccgaatagagctatagtagctttcaaagatgaagatgaatggacactaatagatgataactttcactttttattttcctttcatccaaatgacttcataagaatcacacagaaaaacaaagcacctatattaggatattatgcatcatgtcaccgaggaactggcaatctaaatctatgggcacatgatcgaaatcaaaaagtaggtaaagatggacaaattgaaggaattggggtaaagaccgcggtagctctagagaaatttcacgtagacgtgttaggaaatatatatccagcgcccccagaacaacgacacggactagcatga

SEQ ID NO: 5112 - RNA, 3366 nt, synthetic construct
  misc_feature 1..3366: note = Cas9 variant
  source 1..3366: mol_type = other RNA
atgtcagatttagtattaggattagacataggaataggatctgtaggtgtaggcatattaaataaagttactggagagataatacataaaaatagcaggatatttccagccgcacaagcagaaaataaccttgttcggagaacaaaccgacaaggaagaaggcttactagacgtaagaaacaccgcagggtcaggctaaaccgcttgttcgaagaaagcggactaataaccgatttcacaaaaatatcaattaatctaaatccatatcaactacgagtgaaaggtttaacagatgagctatcaaatgaagaactcttcatagccctaaagaacatggtcaaacaccgcggtatatcctatctagacgacgcgagtgacgacggaaactcatcagtaggcgattacgcacaaatagtgaaagaaaattccaaacaactcgaaacaaagaccccaggccaaatacaactagaacgttatcaaacttacggacaattacgaggtgattttacagtcgaaaaagatggtaagaaacatcggcttattaatgtattcccaacaagtgcctatcgatcagaagcattacgaatcctacaaacacaacaagaatttaatccacaaataactgatgagttcataaataggtatttggaaatactaacaggcaaacgaaaatattaccacggccctggtaacgagaaaagtcgaacagactacggaagatacagaacaagtggagaaactctagataacatattcggaatattaataggaaaatgcactttctatccagacgagttcagagcagcaaaggcttcatataccgcccaagagttcaatttactaaacgacttaaacaacttaacagtaccgacagaaacaaagaaactcagtaaagaacagaaaaaccaaataatcaattacgttaaaaatgaaaaagcaatgggaccagcaaaattattcaaatacatagctaaactcttatcatgcgacgtagctgacataaaaggctatagaatcgataaaagtggcaaggccgaaattcacaccttcgaagcatatagaaagatgaaaacactcgaaaccttggacatagaacaaatggatagggaaacactagataaacttgcatatgtattaacactaaacaccgaaagggaaggaatacaagaagcactagaacacgaatttgcggatggatcattctcacaaaaacaagtagacgaactcgtacaattccgaaaagcaaactcaagcatattcggtaaaggatggcataatttctcagtaaaactgatgatggaactaataccagaactatacgaaacctcggaagaacaaatgacgatactaacaaggttaggcaaacagaaaacgacatcatcatcaaataaaactaaatacatagatgaaaaactattaacagaagaaatatacaacccagtcgtagccaaaagtgtccgacaagctataaaaattgttaacgcagctataaaagaatatggcgacttcgataatatagtaatcgaaatggcacgagaaacaaatgaagacgacgaaaagaaagcgatacagaaaatccaaaaagcaaacaaagacgaaaaagatgctgcaatgctaaaagcggctaatcaatataacggtaaagctgaattaccccactcagtattccacggccataaacaactggctacaaaaattagactctggcaccaacaaggagaacgatgtctatatacaggaaaaaccatctcaattcacgatctcataaacaatagcaatcaattcgaagtagatcatattctacctctctctatcacctttgatgactccctagcaaacaaagtactcgtatacgccacagcaaaccaagaaaaaggacaaagaacaccctaccaagcactagactcaatggacgacgcatggagttttcgtgaacttaaggcatttgtaagagaaagcaagacattatctaacaaaaagaaagaatacctcttgaccgaagaagacatatcaaaattcgatgtcagaaagaaatttatcgaacgaaatcttgtcgacacgcgatatgcttcaagagtagtactcaacgccttacaagagcattttagagcacataaaattgatactaaagtatcagtagtccgaggacaatttacaagccaattacgtcgacattggggaatagagaaaaccagagacacataccaccatcacgctgtggacgccttaataattgccgcatcgagccaattaaacttatggaagaaacagaaaaacacactcgtcagctactctgaagatcaactactagacatcgaaacaggcgaactaatatccgatgatgaatacaaagaatcagtattcaaagcgccctaccaacactttgtagatacattaaaatcaaaagaatttgaagacagtattctattctcatatcaagtagatagcaaatttaacagaaaaatctcagatgcaaccatatacgcaacaagacaagccaaagtaggaaaagacaaagctgatgagacatacgtactaggaaaaatcaaagacatatatacacaagacggatacgatgcattcatgaaaatatataagaaagataaatcaaaattcttaatgtatcgacacgatccacaaacctttgaaaaagtaatagaacccatcctagaaaattatccaaataaacaaataaatgaaaaagggaaagaagtaccctgtaacccatttttaaaatacaaagaagaacatggctacatacgaaaatactcgaagaaaggaaacggacccgagatcaaaagcctaaaatattacgacagcaaactcggcaatcacatagatatcacccccaaagactccaacaacaaagtagtactacaaagtgtatctccatggcgagccgatgtctactttaataaaaccacaggaaaatatgaaatactaggcctaaaatacgccgatctacaatttgaaaaaggaactggaacatataaaattagtcaagaaaaatataacgatattaaaaagaaagagggagtcgacagtgacagcgaatttaaattcactctatataaaaacgatctactattagtaaaagatacggaaacgaaagaacaacaactcttccgatttctaagcagaacaatgccaaaacaaaaacactacgtagaactcaaaccatacgacaaacaaaaattcgaaggaggtgaagcactgataaaagtattaggtaatgtagcaaacagcggacaatgtaaaaagggcttaggtaaatcaaacatatcgatatataaagtgagaacagatgtactaggaaatcaacatataatcaaaaacgagggcgataaacctaaactcgacttctga

SEQ ID NO: 5113 - RNA, 3366 nt, synthetic construct
  misc_feature 1..3366: note = Cas9 variant
  source 1..3366: mol_type = other RNA
atgaatggtctagtattaggactcgacattggaatcggatcagttggagtaggaatactaaataaagatacaggcgaaataattcatgcaaactcaagaatattcccagcagctaccgcagataacaacgttgtaagacgttcttcccgacaagggagacgattaaaccatcgaaagaaacatcgatccgtgcgactaaaagatttattcgaatattatgacctacttacggatttcagtaaagtaagtattaacctaaatccctaccgcctccgcgtagatggattaaatcaacaattaacaaatgaagaattatttatagcactcaaaaacatcgttaaaagaaggggcatcagctatttagatgatgccagtgaagacgggggcgcagtatcctcagactatgggaaagcagtcgaagaaaatcgaaaattactcgctgaacagactccaggacaaattcaattagaacgattcgaaaaatacggtcaagtcaggggagattttacagtcgtagaaaatggagagaaaaggcgattaatcaatgtcttttcaacatcagcatataagaaagaagccgaaagaatccttagaaaacaacaagaatacaataaccaaataatggatgaatttatagcagactaccttacaatactaacaggaaaaagaaaatactatcacggcccgggaaacgaaaaatcaaggacagactacggtcgattcagaaccgatggtactacactagataacatcttcggtatcctcatagggaaatgcacattttatccagaagaatatcgcgcaagcaaagcatcatatacagcacaagaatttaacctattaaacgatctaaataatcttacagtccctactgaaaccaagaaattgtcagaagaacaaaagaaaacaatagtcgaatacgcaaaatctgcaaaaacactcggagcaagcaccctactaaaatacatagctaaaatgatagacgcatccgtagaccaaataagaggttatagggtagatgttaacaacaaacctgaaatgcacacttttgaagtatatagaaaaatgcaactattagaaaccataccagtgggcgaattttcaagggaagtcctagacgaattagcacacatattaaccctcaacaccgaacgagaaggtatagaagaagcaataaacaccaaactaatggacgtcttttcacaagaccaaatcctagaattagtacaattccgtaaaaataatagttcgttgttcagcaaaggctggcacaacttctcactaaaacttatgatagaactaataccagaactatacgaaacatccgaagaacaaatggccatattaacaagactcggtaaacaaaaattcaaagaaacctccaaaagaacaaaatatatagacgaacaggaagtaacagaagaaatctacaaccccgttgtggccaaatctgtaagacaggccataaaaatcattaatgaagccacaaagaaatacggaatatttgataacattgtaatagaaatggcaagagaaaataacgaagaagaagctaagaaagactacataaaaagacaaaaagcaaatcacgatgagaaaaacgccgcaatggaaaaagctgcattccaatataatggagaaaaagaactacctgactccatctttcatggacacaaagaattggcgacaaaagtaagactctggcaccaacaaggagaaaaatgcctatatacggggaaaaacatcccaatctcagatctaattcataaccaatacaaatacgaaatagatcacatactccccctaagtcttagctttgacgacagtctatcaaacaaagttttagtcctagctacagctaatcaagaaaaaggacgccgaacaccctttcaagcacttgattccatggatgacgcttggtcttatcgggaatttaaaagttatgtgaaagacagcaaatcgttaggaaacaaaaagaaagattacctgttaaccgaagaagacatctcaaaaatagaagtaaaacaaaaatttatagaacggaatttagtagacacccgctactcatcaagagtagtactaaacacacttcaagacttctacaaagcacacaaattcgacaccacaatcagcgttgttcgtggacaattcacctcacaactcagacgtaaatggggcttagaaaaatcgcgggaaacttaccatcaccacgcggtcgatgctctaatcatcgccgcaagctcccagctaagactatggaagaaacaaaataatcccttaatatcatacaaagaaggacaatttgtagactcagaaacaggagagataataagtttaacggatgacgaatataaagagctagtcttcaaagcaccatacgatcattttgtggacacactcagatcgaagaaattcgaagattcaattctatttagctatcaagtggatagtaaatttaacagaaaaataagtgatgcaaccatatacgcaactagaaaagcgaaactagataaagacaaatccgaagaaacatacgtactcggaaaaataaaagatatatactcccagtccggttacgatgcctttattaaaatatataataaagataaatccaaatttctgatgtatcataaagacccacaaaccttcgaaaaagttattgaagaaatactacgaacctacccatcaaaagagttcaatgagaaaaataaagaagtcagttgcaaccccttcgaaaaatataaacaagaaaacggaccaatacgaaaatatagcaagaaaggaaacggccccgaaataaaaagtctaaaatactacgacaaaaatataccagaatcatttattaatatcaccccatccaactccaaaaacaaagtaatcttaagacaattaaacccttggcgaaccgatgtatatttcaaccatcaaacagaaaaatacgaattacttgggttaaaatatgcagatctccaattcgaaaagaaaacaggaacctactcgattactatagacaaatataacgaaataaaagaaaaagaaggagtatcagaacactcagagttcaaattcacactatataaaaacgatttacttttaattaaagatacagaaataaaagaagaacaaatattcagattcctatcaagaaccatgcctaaccaaaaacactacgtagaactaaaaccatattacaaaggaaattttgaaggcaaagaaagaatcaaagtattcaatacaacctcaaatggacgatgcttaaaaggactacgaaagaaaggactaagtatatacaaaattaaaacagacgttctcggtaataaacattttataaagaaagaaggcgaaaaacccaaactaaaattttga

SEQ ID NO: 5114 - RNA, 3369 nt, synthetic construct
  misc_feature 1..3369: note = Cas9 variant
  source 1..3369: mol_type = other RNA
atgaacgggaaaatactaggattagatatcggtgtggcatcagtaggtgttggaatattagataagaaaacgggtgaaattatacacgcatcatcgagaatatttcccgccgctacagcagattccaatgtagaacgaagaggattcagacaaggacgtcgattgggcagaagaaagaaacaccgcaaagttaggctcgcagacttattctcagacacaggactaataacagatttctcaaaagtgagtataaatttaaatccttatgaattacgtataaaaggcctcaatgaaaaactaacaaatgaagaactctttatagccctgaaaaatatagtgaaaaggaggggaatttcgtacctagatgacgctaacgaagacggggaatcaagctcatcagaatatggaaaagctgtcgaagaaaaccgaaaactactagctgacaaaactccaggtcaaatacaactagaacgattcgaaaaatatggacaagttaggggagattttacaatagaagaaaacggagagaaacacagactattaaacgtcttctcaacctctgcatataagaaagaagcagaaagaatattaactaaacaacaagattacaatcaagacattacagacgaatttatacaagcatacttaacgatattaactggaaaaaggaagtattaccacggaccgggcaacgaaaaatcccgaactgattacggtagattcagaacagatggcactactctagacaacatatttgggatactaatcggaaaatgcacattttacccagaagagtacagagcggcgaaggctagttatacggcacaagagttcaatctgctaaacgacttaaataatctaacagtacctacagaaacaaagaaattaagcgaagaacagaaaagacaaataattgaatatgctaaaggagcaaaaacattaggcgcagcaacgctactaaaatatatagcaaaattagtagacggaagcgtagaagatataaaaggctatcgaatagataaaagtgaaaaaccagaaatgcacacatttgacatttacaggaagatgcaaactctagagacagtggacgtagaaaaactatcaagagaagtacttgacgaactagcgcatatattaaccctaaatacagaaagagagggaatagaagaagcaatcaaagtatcattcataaaaagagagtttgaacaagaccaaatagctgaattggtatcattccgaaaatccaactcatccttgtttggaaaaggatggcacaacttcagcataaaactaatgaccgaactaatccccgagctatatgaaacatcggaagaacaaatgaccatattaacaagactaggcaaacagaaaactaaagcaaggtccaaacgtactaaatatatcgatgaaaaagagctaacagatgaaatatacaacccagttgtagcaaaaagtgtacgacaagccataaaaataattaacctagccacgaagaaatacggcgtattcgataacatcgttatcgaaatggccagagaaaacaacgaagaagatgcaaagaaagactatgtaaaacgacaaaaagctaacgaagatgagaaaaacgcggctatggaaaaagcagcgcaccaatacaacggaaagaaagaattgccagacaatgtctttcacggacataaagaactggcaaccaaaataagattatggcaccaacaaggcgaaaaatgtctctacacaggtaaaaacataccaatatccgatttaatacataatcaatataaatacgaaatagatcatatattacctctatcactcagctttgatgattcactagcaaataaagttctagtattagccaccgctaaccaagaaaaaggacaacgcacacccttccaagcgctagactcaatggacgacgcatggtcatacagagagttcaaggcttacgttcgcggagcacgcgccctaagtaacaaaaagaaagattatctattaaatgaagaagatataaacaaaatagaagtaaaacaaaaattcatagaacgcaacttagttgacacacgctactcgagcagggtagtacttaatgcattacaagacttctacaaactaaatgactttgatacaaaaatatctgtggtccgcggacaatttacctcacaactaagaagaaaatggcgaatcgacaaatcaagagaaacttatcaccatcacgcagttgacgcattaatcatagctgcatcttcacaactaagattatggaagaaacaaggcaacccactcatatcctacaaagaaaatcaatttgtcgatagcgaaacaggagaaataatatcacttacagacgacgaatataaagaactcgtattccgtgcaccgtacgatcactttgtcgatacagtatcatccaagaaatttgaagacagaatactattctcctatcaagtcgacagcaaatataacagaaaaatcagtgatgcaacaatatactcaactagaaaagcgaaactaggaaaagataaatcagaagaaacatacgtactaggaaaaattaaagatatatatacacaaactggttatgacgccttcattaaactatacaagaaagataaatccaaatttctaatgtaccataaagatccaataacatttgaaaaagtaattgaagaaatcttaaaaacttacccagacaaagaaattaacgaaaaaggcaaagaagtagcttgtaacccatttgaaaaatatagacaagaaaacggtccgctacgtaaatactcgaagaaaggaaaaggtcccgaaataaaatccctaaaatactacgacaacaaattaggtaatcatatagacatcacaccagacaacagcgaaaaccaagttatactgcaatcacttaaaccttggagaacagacgtatactttaaccataaaacaaaaatatacgaattaatgggcctcaaatactctgacctatcatttgaaaaaggctcaggaaaatatagaatatcactagataaatataacgtaattaaaaagaaagaaggcgtacacaaagaaagtgagtttaaattcacactctataaaaatgatttgatactaattaaagacttagagaaaagcgaacaacaactctttcgatataacagtcgaaatgacacatcaaaacactatgtagaattaaaaccatatgacaaagcaaaatttgaaggaaaccaaccattaatggcgctatttggaaatgtcgcaaaaggaggacaatgtctaaaaggtctcaacaaagctaatataagtatatacaaagtacaaacagatgtcttaggcaacaagagatttattaagaaagaaggtgacgcacctaaactggagttctga

SEQ ID NO: 5115 - RNA, 3369 nt, synthetic construct
  misc_feature 1..3369: note = Cas9 variant
  source 1..3369: mol_type = other RNA
atgagtgacttagtacttggattagacataggaattggcagtgtaggggtaggaatattaaataaagttacaggagaaataatccataaaaacagtcgaatcttccctgcagcacaagcagaaaacaacctagtaagaagaacaaacagacaaggaagaagattaacgaggaggaagaaacatagaatcgtaagactcaataggctatttgaagaatctggattaataactgattttacaaaaatatcaattaatcttaacccatatcaattacgagtcaaaggattaaccgacgaactgtcaaatgaagaactattcatcgccctgaaaaacatggtcaaacacagaggcatatcatacctagacgatgccagtgacgacggtaattcgagcgtgggcgactatgctcaaatagtcaaagaaaactcaaaacaactagaaacaaaaacaccaggacaaatacaactcgaaagatatcaaacctacggacaactaagaggagattttaccgtcgaaaaagacggaaagaaacacagactaataaatgttttcccaacctcagcatacagatcagaggctttaagaatattacaaactcaacaggagttcaactcacaaattacagatgagttcataaaccgatatctagaaatattaaccggaaaaaggaaatactaccatggtccagggaatgagaaaagccgaacagactacggacgctataggacgaacggagaaacacttgacaatatattcggaatacttataggaaaatgcacattttatcccgatgagttcagagctgctaaagcatcatacacagcacaagaatttaacttattaaacgacctcaacaatctgactgtaccgacggaaactaagaaactctcaaaagaacagaaaaatcaaataataaattatgtcaaaaatgaaaaagtaatgggacctgcaaaattattcaaatatatcgcaaaactattatcatgtgatgtagcagacataaaaggacacagaatcgacaaaagtggtaaagccgaaattcacacattcgaagcgtacagaaaaatgaaaacactagaaacattagatatcgaacaaatggatagagaaactttggataaactagcatacgttttaactctgaacaccgaaagagaaggaatacaagaagcactggaacacgagttcgcagacggcagcttctcacaaaaacaagtagacgaattagtgcaattcaggaaagcaaattcatcaatatttggaaaaggatggcataatttcagtgtaaaacttatgatggaattaattccagaactatacgaaacatcggaagaacaaatgacaatattaacaaggttaggaaaacagaaaacaacgagctcaagcaataaaaccaaatatatagatgaaaaattattaacagaagaaatatacaatcccgtagtagccaaaagcgtacgacaagctataaaaattgtgaatgcagcaataaaagaatacggggacttcgataacatcgttatagaaatggcccgagaaacaaacgaagatgatgaaaagaaagctatacagaaaatacaaaaagctaataaagatgaaaaagatgccgcaatgctaaaagcagccaaccaatataatggtaaagctgaacttccacattcagtttttcatggacacaaacaactcgcaacaaaaatacgattatggcatcaacaaggggaaagatgtttatacacaggaaaaactatttccatacacgacctaataaataaccctaaccaattcgaagtcgaccatatactacccctatcaataactttcgatgatagtcttgcaaacaaagtactcgtgtacgctaccgctaaccaagaaaaaggccaaagaacaccataccaagccctagacagcatggacgatgcttggtcattcagagaactcaaagcatttgtacgagaatctaaaacgctatcaaacaaaaagaaagaataccttttaactgaagaagacatatcaaaatttgacgtaagaaagaaatttattgaacggaacctagtagacacacgttatgcttctagagtagtattgaatgccttacaagaacatttcagggcacataaaatagatacaaaagtttcagtagtacgtggacaatttacaagtcaactccgaagacattggggcatagagaaaacaagagatacataccatcatcatgccgtagatgcattaataatcgcagcatcgagccaattaaatctctggaagaaacagaaaaacacacttgtctcctacagtgaagaacagctccttgatatagaaacgggggaactcataagcgacgacgaatataaagaaagtgtattcaaagcaccataccaacatttcgtcgatactttaaaatcaaaagaatttgaagatagcatactatttagctaccaagtagatagcaaattcaacagaaaaatttccgacgcaaccatatacgcaacacggcaggcaaaagtaggaaaagacaagaaagatgaaacttatgttcttggaaaaataaaagacatctatacacaagacggctatgatgcatttatgaaaatatataagaaagataaatcaaaatttttaatgtatagacatgatcctcaaacttttgaaaaagtaatagaaccaatacttgagaactacccaaacaaagaaatgaatgaaaaaggaaaagaagttccctgcaatccgttcctcaaatataaggaggagcacggatacataagaaaatattcaaagaaaggaaacggacctgaaataaaaagtctaaaatactacgacagcaaattactaggaaacccaatagatataactccagagaactccaaaaacaaagtagtactacaaagtctaaagccatggcgaacagatgtctacttcaataaaaacacaggaaaatacgagatcttaggattaaagtacgcagatttacaatttgagaagaaaacagggacatacaaaatatcacaagaaaagtataacggaatcatgaaggaagaaggtgtagacagtgattcagagttcaagttcacactatataaaaacgaccttttactggtaaaagacacagaaacgaaagaacaacaactatttagatttttatcaagaacaatgcccaatgtcaaatactacgtggaactaaaaccatattctaaagacaagttcgagaaaaatgaatccttaatagagatattgggatctgcagacaagtcgggaagatgcatcaaagggctaggtaaaagcaatatatcaatatataaagtaagaacagacgtattgggtaaccaacacataatcaaaaatgagggagacaaaccaaaactagacttttga

SEQ ID NO: 5116 - RNA, 3369 nt, synthetic construct
  misc_feature 1..3369: note = Cas9 variant
  source 1..3369: mol_type = other RNA
atgagcaatggaaaaatattaggcttagacataggtatagcaagtgtaggcgtcggagtaatagacgcacaaacaggagaaatcatacatgcaagctcaagaatttttccatcggcaaatgcagcgaataacgccgagagaaggacatttagaggatcacgaagactaattcgacgaaagaaacatcgaataaaaagattagatgatttattcaatgatttccacattaacttagatggagaaatgagtacagacaacccatatgtactaagagtaaaaggtttaagtcaaaaacttacagtagaagaactatacatcagtatcaaaaacataatgaaaagacgtggcataagttatttagacgatgcagaatcagataacgaagccggaagaagcgattacgcaaaagcaatagaaagaaatagacaactgcttacttcaaaaactcctggagaaatccaacttgaaagacttgaaaaatatggccaattaagaggaaactttactataattgacgaagaaggtcaaagccaacaaattataaatgtatttagcacatccgattatgtcaaagaagtagagaaaatcctagattgtcagaaaatgtatcacaaattcatatcagacgagttctgtgacaaattgatagaactactcagagaaaaacgtaagtactacgtcggcccaggcaacgaaaaatcaagaacagactatggaatttacagaacagatggcacgacattagaaaatctctttggtatacttataggcaaatgcacattttacccagaccaatacagatcaagcagagccagctacacagcacaagaatttaactttttaaatgacctaaataatctaactgtaccaaccgaaactaagaaattaagtcaagaacaaaaagagttcttagtcaattatgccaaagaaacatcggtactaggggcaggaaaaatactgcaacaaatagctaaactagccgattgcaaagtagaagacatacgcggatatcgattagacaacaaagacaaacctgaactacatatttttgaaacttacagggcaatgaaaggtttagttccattagtagacatcggagtgctttcaagagaacagctagacattttagcagatatactaactttaaacacagatttcgaaggtataagagaagcattaaagaaacaactccccaacgtttttgatgaaaaacaagtaaaaggcctcgctagctttcgcaaaagtaaatcgcaactatttgctaaagggtggcataacctaagccagaaaattatgttagaagtaatcccagaattatacgccacatcagatgaacaaatgacaattctaacaaggttgggtaaattcgaaaagagttctgtggcagaatatccaagcagtataaatgtagacgaaataacagacgaaatatacaatcctgtagtcgctaaatcgataagacaaaccataaaaatcataaacgcatcaataaagaaatggggagaatttgaccaaatagttatagaaatgccacgagatagaaacgaagatgaagaaaagaaaagaatcgcagacggacaaaaagccaacgcgaaagaaaaagcagactcaatattaagagcagctgaactttactgcgccggtaaagtacttcctgattacgtctacaatggacataatcaactcgccaccaaaataagactttggtatcaacaaggcgaaagatgcatatacacaggacaacctataagcattcatgacctaatacataatcagaaccaatacgaaatagatcacatattaccattaagcctaacatttgatgattcactaagtaacaaagtacttgtcctagcaacagcaaatcaagaaaaagcacagcgtactccatataattacttaaaatcagcaacatctgcatggagttacagagagttcaaagattacgtaacaaaaaggaaagggataggtaaaaagaaatgtgaatatttaacttttgaagaagatattaatggctttgaagtaagaagtaaatttattcagcgaaatctcgttgacaccagatacgcaagcaaagttatattgaacgcgttacaagattacttcaaaatatcaggaatacaaacaaaagtatcagttgtcagagggcagttcacaagccaactcagacacaaatggggaatagagaaaacaagagaaacttatcaccatcacgcagtagacgccttaatcattgctgcaagttcccaactaagactttggaagaaacaggaaagcccactcgtggtagactatcaagaaggacgtcaagtggacctagaaaccggtgaaatcctagaactcacagatgaacaatacaaagagctagtttatcaaccaccttatcaaggatttgtgaacacaataagtagttcagcatttgacaatgaaattctatttagctaccaagttgacagtaaagtcaatagaaaaataagcgacgctactatttacgcaactagaaacgcacaattaggaaaagacaaaacagaaggtatttacgttctcggaaaaatcaaagacatctacacacaagctggctacgaagcgtttctcaaaagatatacaaaagataaaacatcattcctaatgtatcacaaagatctcgatacatgggaaaaagtcattgaaataattctaagagactacagagaatatgatgaaaaaggaaaagaaatagggaacccattcgaaaggtacagacgagaaaacggctacgttaagaaatattcgcgcaaaggcaatgggacggctataaaatcattaaaatattacgataacaaattagggaaccacatagacataacaccagaaaactctagaaacgcagtagtattacaatctttaaaaccatggcgaacagacgtatatttcaacaaagaaacaggtaaatatgaatttttaggcatcaaatacagcgacctcagctttgaaaaaggaactggggaatatggaatatcacaagaaaaatacgattcaataaaaatcgcagaaggagtcgcaaagaaatcaatttttaaatttaccttatataaacaagatcttctattcattaaagacatagagaacaatttcggaaaactattaagattcacatccaaaaatgacacatcaaaacattacgtagaactaaaaccatatgataaaaataaatttggaacagaagaaccactattaccagtacttggaaacgtagcaaaaagcggacaatgcataaaaggattaaacaaatcaaacatatccatttacaaagtacgaacagatatcctcgggtacagacattttataaaacaagaaggagaacatccgcaactaaaatttaaaaagtga

SEQ ID NO: 5117 - RNA, 3369 nt, synthetic construct
  misc_feature 1..3369: note = Cas9 variant
  source 1..3369: mol_type = other RNA
atgagtaacggtaaaatattaggcctagatattggtatagcatcagtaggcgtaggcgttatagatgcacaaacaggagaaattattcacgcatctagtagaatattccctagtgccaacgcagcaaacaacgcagaaagacgaacattcagaggctcgaggcgcctaatcagaagaaagaaacatcgtattaaaaggttagacgaccttttcaatgacttccatataaacttagacggcgaaatgtccacagataacccatacgttttacgcgtgaagggattatcacaaaaactaactgttgaggaactatacattagcattaagaacataatgaaaagaagaggcataagctatcttgacgacgcagaatcagataacgaagcaggaagatcggactacgcaaaagctatagaacgaaataggcagctgctcacctcaaaaacgcccggagaaatacaattagaacgacttgaaaaatacggacaacttcgaggaaacttcacgataattgacgaggaaggacaaagccaacaaatcatcaatgtattttcaacatccgactatgtcaaagaagtagaaaagattctagattgtcagaaaatgtaccataaatttattagtgatgagttctgtgataaactaattgaactactccgcgaaaagagaaaatactacgttgggccaggaaacgaaaaatcaagaaccgattatggtatatatagaacagacggaacgaccttagaaaatctattcggtatacttatagggaaatgcacattctacccagaccaatatagaagtagtagggccagttacacggcacaagaatttaatttccttaacgacctaaacaaccttacagtaccaacggaaactaagaaattatcccaagaacaaaaagaatttttagtaaattacgcaaaagaaacgtctgttctaggagcgggaaaaatactccaacaaatcgcaaaattagcagattgcaaagtggaagatatccgaggatacagactcgataataaagacaaaccagaactacacacattcgaaacatatcgcgccatgaaaggtctagttccgcttgtagacattggagtactaagtagagaacaactagatatactagcagacatattaactctaaacacagatttcgaaggaatacgtgaagcactaaagaaacaattgcccaacgtattcgacgaaaaacaagtaaaaggactagcatctttcagaaaaagcaaatcacaactattcgcaaaaggatggcacaacttaagtcagaaaattatgttggaagtcataccagaactctacgcaacaagtgatgaacaaatgacaatattaactagattaggaaaattcgagaaaagctcagttgcagaataccccagttcaataaacgtcgacgaaataaccgacgaaatttacaatcctgtagtagccaagtctatacgacaaaccatcaaaatcataaatgctagcataaagaaatggggcgaatttgatcaaattgtcatagaaatgccacgtgatcgaaacgaagacgaagaaaagaaacgaatagccgatggacaaaaagcaaacgcaaaagaaaaagcagattcaatactcagagctgccgaactatactgcgccggaaaagttctaccagactacgtctacaatgggcataaccaattagctacaaaaatacgactgtggtaccaacaaggtgaaagatgtatatacacaggacaacctataagcatacacgatcttatacataaccaaaaccaatatgaaatcgaccatatactacctctatccttaactttcgacgacagtctatcaaataaagtattagtactagcaacagcaaatcaagaaaaagcacaacgaacaccatacaattacctcaaatcagcgacaagcgcttggtcatatcgcgaatttaaagattacgtaacaaaacgaaaaggaataggtaaaaagaaatgtgaatacttaactttcgaagaagatattaacggatttgaagtacgatcgaaattcatacaaagaaacttagtagacaccagatatgcatcaaaagtaatcttaaatgcactccaagattactttaaaataagcggcattcaaacaaaagtttcagtagtacgtggacaattcactagccaattaaggcacaaatggggaatagaaaagaccagagaaacataccatcaccacgcagtcgacgctctaattatagcagcatcgtcacaactacggttatggaagaaacaagaaagccctctagtagtcgactatcaagagggaagacaagttgacttagaaactggagagatattagaactaaccgacgaacaatataaagaacttgtatatcaaccgccctatcaaggatttgtgaatacaatatcatcttccgccttcgacaatgaaatactcttcagctaccaagtagatagcaaagtaaacagaaaaatttcggacgcaacaatttacgcaacaagaaatgcacaactcggcaaagataaaacagaaggaatctacgttttaggaaaaatcaaagacatttatacacaagccggttatgaggcattcctcaagagatacacaaaagataagacatcctttcttatgtaccacaaagacctcgatacgtgggaaaaagtaatagaaataatactacgagattaccgagaatacgatgaaaaaggaaaagaaataggaaatcccttcgaacgatacagaagagaaaatggatatgtaaagaaatactctagaaaaggaaacggaacagcaataaaaagcctcaaatattatgataacaaactaggcaaccacatcgacataacaccagaaaatagtcgtaacgcagtcgtactacaatctctcaaaccatggagaacagatgtatacttcaataaagaaacaggaaaatacgagttcctcggcattaaatatagcgatctttcctttgaaaagggaacaggagaatacggcatatcacaagaaaaatacgattcaataaaaatagccgaaggtgtggctaagaaaagcatcttcaaattcaccctttataaacaagaccttctattcatcaaagacatagaaaacaacttcggcaaattattaagattcacaagcaaaaatgacacaagtaaacattacgtagagctcaaaccatatgataaaaataaattcgggactgaggaacccttactgccagtgttaggtaacgtcgccaaaagtggacaatgtataaaaggattaaataaaagcaacatatctatctataaagttagaactgacatactaggataccgccactttataaaacaagaaggtgaacacccacaattgaaattcaagaaatga

SEQ ID NO: 5118 - RNA, 3372 nt, synthetic construct
  misc_feature 1..3372: note = Cas9 variant
  source 1..3372: mol_type = other RNA
atggcaaaaatattaggactagacctaggaacaaacagcataggatgggcattaatagatgatgtacaaaataaaattttaggagttggatctagaatcttcccaatgggcgtagaaaatctaggagacggcgatggggaaatcagtaaaaacgcaagcagaacgggcactcgaggagtgagaagacaattctttcgaagaagattacgaaagaaagtattattaaaagcactaagcgaaaataacatgtgcccaatgatcacatcagacttcgacaactggaaaaagacaaaacaatttccaagtgaaaaattagcatcatggttcgctttaaatccatacgaattgcgtaataaagcactaagcgaaaaacttacactagaagaaataggcagaatattctaccacctaattcaacgccgtggattcttgagcaattcaagaaaaggaggcacagatgacggagctatattcaaaggaaatccaaaagaaggcaaaatcggcataacagatacacaagagtctatacaagacaaaacactaggtagctatctatttgaaatatatccaaaggaaaatcaaccatttcaaaatggattagaaagaataagaaaccgttacacagttagaaaaatgtatgtagacgagttcgaaatgatatgggaaaaacaggctcaatactattccaatctcaatgaagatctcaaaacactatttgggggaagaaaattagatggatataaagaagatggaatactctttcatcaaagacccttaagatcacaaaaacacctagtcggaaactgtgtattcgaaccaaacaaaacgaaatgtccgatctctgctatcccatttgaacaatttagagtatggcaatgggtcaatacagtagaatataatggaaagaaaataagccaagtcgaaaaagagaaaatagtagaatttttatatgcaaatgacaaaacagattttaagaaaataagaaaagccataggcaaagaatccacagagttcaaattcaactataaagacgatgataaaatagtgggaacatacacagttagccatctcagcaacaagaaatattttggaaagaaatggtttgaatttagcgaaaaagaacaagaagacatatggcatatactgtatttctttgattctaaatctaacttaaaagaatacgcaattaaaaactggaattttacagaggaacaagctgaaagtatagcgaaatttaatgtcaaagacggttacagcagcttatcaaggaaagcaataagtaacattctaccgttcttaaaactcggattcacatacgacgtcgcagtagtcttgggaggcattaaaaacgtttttggacatgaatgggaaaaactttcagatgaaaagaggaactttttaatcgacaatgtagaaggcattgtcagaagtaaaacaaaaggaggattcatagatgtcataaaagacatattaagaaatgattataatataagcgacaaccaacttcgtaaactatatcatcactcagctacaatctatgttgcggaacttttagaaaaactacccgttgggaaagaagcagataaagaaatccaatcgatacgaaatccaatcgtaataacagctttgttcgaattaagaaaacttgtcaatgaactgatcgacgattttggttcaatcgatgaaatcaaagtagaaatggcaagggatctaaaaatatcaaaatcgcaaaggaataaaatccgaagagaacaaaagaggctagaaagagaaaacgatagagtgaaagcaaggctcttagaagagggccaacgaatcacacatgacaacatactactatacaaattatgggaagagtgcaagaaaacatgcccttacacaggaaacccgatacctttatataaactcttcactggagagatccaaatagaacatatacacccctggtcaagaagtctaaatgattcatttgcaaacaaaacactatgttatgcagatgagaacaggaagaaaggggacaaaacaccctacgaattttacggaaacgacgagagcaactggtcagcaattaaagaaagagccttaaaattattttcagacaccaaagaatatccaaacgcctaccaaaaatttaaaagattcgtccaacataaattcgatgatgacttcagttcacgacaacttaacgacactcgctacatatccaaagaagcgaaaaattacttaagcaaaatatgtaagaaagtagcagtaagccccggacaggcaacatcaaacttacgacaaaaatggggcatgaataatatcttaaacgatgaaaacgagaaaacacgagaagatcacagacatcatgccatagacgcgttggtaatggcttgcacaaaaataagttacgttcaagaattgagtaaatggaatcgatataataggaacgcagaactaaagaaattccccttaccatgggaaacattctggtcagacgcaaatcgtgcagtagacaaaattctcatatcacacaagaaagtatccaacgatataacaggcaggacacacatcagtgagaaaaatggaaagaaatataaaaacgtaggagtagcagcaagaggacagttacacaaagaaacagtatacggaaaacgaacttttaatggagaagaagccttccacgtacgtaaaaccattgattcactgacgacagaaaaacaactagaaaaagtcgtagatgaatcaataaaactattgataaagaaaagagtacaagaactaggaggttttgttaaaggggcaataccagccaatacattctttgtagtagacgaaaacggaataaaacaaccacaaatcttcttgccaaataaaaatggagccccagtaccagtattgaaagtgagaatgaaagaaaatataggaggagcagaaaaattaaaagaaaatgttaaccaatgggtaaatccaagaaataatcaccatgtattaatatataaagacgaaaaaggaaatctaaaagaagaagtagtgacattctggactgtagtagaaagaaaacgaacgggacaatcagcctaccaattaccatttgatggaaaagaaattgtaacaaccctacatataaatgacatgtttcttttaggactaaacgaagaagaaataaactgggaaaacccagactatgaagttctaaaagaacacctttatcgcgtccaaaaatttacgagcggagattattacttcagaattgctaaaacttcaagtattcaaaacgccatcgaaaaacaacaaataaattcttttgggtttggcaaaaatggatggagtacccataacccaatcaaagttaaaatatccgtaagtggaaaaatctcaaaagtatga

SEQ ID NO: 5119 - RNA, 3372 nt, synthetic construct
  misc_feature 1..3372: note = Cas9 variant
  source 1..3372: mol_type = other RNA
atgaacggattagttcttggcttagatatcggaatcggtagtgtcggagtaggaatcctaaacaaagatactggtgaaataattcatacaaactcaagaatattcccagcagcaaccgccgataacaacgtagaaagaagaaactcccgacaagctaggcgactaaatcgaagaaagaaacataggggagcaagattgcacgacctcttcgaagattatgatttattaatagatttttcaaaagtatctataaatttaaacccttaccgcctacgagtgcagggactggacaatcccctaaccacagaagaactatttattgcactcaaaaacatagtaaaacgacgaggaatatcatacctagatgatgccagcgaaaatggaggtgcagtaagttcagactatgggaaagcagtagaagaaaatcgaaagctactagctgaacagacaccaggacaaatacaactggaaagatttgaaaaatatggacaggttagaggcgactttacagtcgaagaaaaaggcgacaaacaccgcctaattaacgtattctcaacatcagcatacagaaaagaagccgaacgaatactaaggaaacaacaagaatttaataatcaaatcacagacaaattcatagaagattacctaaaaatactcacagagaaaagaaaatattaccacggaccaggtaacgaaaaatctagaacagactacggaagattccgcaccgacggaacaacacttgataacatattcggaatcttaatcggaaaatgcacattttacccaaacgaatatagggcatccaaagcctcatataccgcacaagagttcaatctgctaaatgatctaaataacctcacagtaccaacagaaaccaagaaactcagcgaagaacaaaagaaaaccatcgtagaatatgctaaatcagccaaaacattaggagcttcaacccttcttaaatatattgccaaaatgatcgacgcatcagttgatcaaatacgtggatacagagttgatgtcaacaacaaaccagaaatgcacactttcgaagtttacagaaaaatgcaatcattagaaacaatccccgtaggcgaattttctagagaagtgctcgacgaacttgcacacatactgacattaaacaccgaaagagaaggaattgaagaagcaattaacacaaaactaatggacgtattcagtcaagaccaaatactagagctagtacaattccgtaaaaataactccagtttattctcaaaagggtggcacaacttttcactcaaactcatgatggaactaatcccagaactatatgaaacctctgaagaacaaatggcaatcctaacgagactgggaaaacaaaaattcaaagaaacctcaaaaagaacaaaatatatagatgaaaaagaagtaactgaagaaatttacaacccagtggtcgcaaaatcagtacgacaggcaataaaaattatcaatgaggcaaccaagaaatatggtatatttgacaacatagttatagaaatggcaagagaaaacaacgaagaagacgctaagaaagactacatcaaacgtcaaaaagcgaaccatgatgagaaaaatgctgcaatggaaaaagcagcattccagtataatggaaagaaagaactacccgatagtatattccacgggcacaaagaattggcaacaaaaataaggctctggcaccagcaaggggaaaaatgtttatacactggtaaaaacatccccatatccgatttaatacataatcaatacaaatacgaaattgatcacatactcccactaagcctatcattcgatgatagtctaagcaacaaagtacttgtattagccaccgcaaaccaagaaaaaggccaaagaacacctttccaagctctcgattcaatggacgatgcctggagctatcgagagttcaaatcttatgtcaaagactccaaattactaggaaataaaaagaaagactaccttctgacagaagaagatatcagcaaaatagaggtaaaacaaaaattcatagaaagaaacctagtcgatacacgttattcatcgcgcgtagtacttaacactctccaagacttctacaaagcacacaaatttgacacaactataagtgttgtccgcgggcaattcacctcacaactcagaagaaaatggggacttgaaaaatccagagaaacatatcaccatcacgcagtcgatgcactcatcatagccgcttcttcacaattaagactctggaagaaacaagcaaacccactaatatcatacaaagaagatcaattcgttgacagcgaaaccggtgaaatcattagcttaacagatgacaaatataaagagctagttttcaaagcaccatacgcccatttcgtagataccttatcctcgaagaaattcgaagatagtatactattttcataccaagttgactcaaaatataaccgtaaaatatcagacgcaaccatatacgcaactcggaaagttaaacttgataaagacaaatctgaagaaacatacgtcttaggcaaaataaaagatatttactcacaagccgggtacgatgcattcataaaaatatataataaagacaaaagtaaattcttaatgtatcacaaagacccacaaacatttgaaaaagttatagaggaaatacttaggacatatccatcaaaagagttcaatgagaaaaataaagaagtgccatgtaatcctttcgaaaaataccgacaagaaaacggcccaatccgaaaatactcaaagaaaggtaacggacccgaaattaaaagccttaaatactatgataaaaatataccagaatcattcatcaatattactccaagtaacagcaaaaacaaggtcatattaagacaattaaatccatggcgaactgacgtatacttcaatcaccaaacagaaaaatacgaactactaggtctaaaatacgcagacttacaatttgaaaagaaaacgggcacatattcaataacaatcgataaatataacgaaataaaagaaaaggaaggggtcggagaacaatcagagttcaaatttacactttataaaaacgacctgttactaatcaaagatacgaaaaacaatgaaaaacaaatattccgattcctatcaagaacaatgcctaatgtaaaacattacgtagaactgaaaccctacgataaagccaaatttgacggaaaccaaccactgataacaatattcggcaatgtcgcaaagggcggacagtgtctaaaaggactaaacaaatctaacataagcatatttaaagtaaaaacagatgtactgggcaacaaacacttcataacaaaagaaggagaaaaaccaaaattaaaattctga

SEQ ID NO: 5120 - RNA, 3378 nt, synthetic construct
  misc_feature 1..3378: note = Cas9 variant
  source 1..3378: mol_type = other RNA
atgaatggactagtactagggcttgacataggcatagcctcagtcggagtgggtattctaaataaagaaacaggcgaaattatacacgtaaactcccgcatatttcctgctgcaaccgcagattcgaacgtagaacgtagaggatttcgacaaggtagacgcttaggaagaagaaaaaaacacagatcagcccgcttgaacgatttatttgaagaattcgggttcataactgacttttcagctgtccctttaaacctaaacccttacgcattaagagtaaaaggactaagcgaagaactaaccaacgaagaactcttcatagcattaaaaaacatcatcaaaagaaggggaataagctatttagatgacgctagtgaagatggagaaacagcctcgaacgaatacggaaaagcagtagaggaaaatagaaaattattggctgacaagacaccaggacaaatccaattagaacgatttgagaaatacggacaggtaagaggagacttcacagtagtcgaaaacggtgaaaaccaccgactaataaacgtattctcaacatcagcttataagaaagaagctgaacgtatactacgtagacaacaagaattcaatgtcagaatctcagacgaattcatcgaagcttacttaacaattctaactggaaaaagaaaatattaccatggtcctggaaacgaaaaatcacgaacagactacggccgatttcgaacagatgggacaaccttagataatatatttggtatattaattggaaaatgtactttctacccagacgaataccgcgcagcaaaagcatcctatacagcccaagaattcaacctgctaaatgatttgaataatcttactgtaccaacagaaacaaagaaattaagaccagagcaaaaacgacaaatcgttgaatacgcaagaacagcaaaaaccttaggaacaccaactctattaaaatacatagcgaaattagtagacggatcaatagacgatataaaaggatatagaatcgacaaaagcgataaaccagaaatgcacacctttgatgcatatagaaaaatgcgcactctagaactcgtagatgtcgatatattatcgagagaaactttagatgatctagcatatatcttaaccttaaatacggaaagtgaaggaattctggaagctttaaatagcaaaatgcctggaacctttacaaaagagcaaatcgatgagctaattcaatttagaaaaaagaacagcgcagtctttggaaaaggatggcacaatttctcacttaaattaatgaatgaactaatacctgaattatacgaaacaagtgaagagcagatgacaattctgacacgcttaggaaaacaaagatccagagaaatatcaaaaagaacaaaatacatagacgaaaaagaactaaccgacgaaatatataaccccgtagtagcaaaatcagtaagacaagcgataaaaatcataaacctggccactaaaaaatatggaatattcgataacatagttatcgaaatggcccgagaaagcaacgaagacgacgaaaaaaaagcgatccaaaatgtccaaaaagcaaatgaagatgagaaaaaagccgcaatggaaaaagcagcagacctatataacggcaagaaagaactacctgatagcattttccacggacataaagaactagcaacaaaaattagactctggcaccaacaaggcgaaagatgcctttatacgggaaaaaacataagcattcatgacctaatccataacccccaccaatatgaaatagatcatatattaccattatcattaagcttcgacgatggactagccaacaaagtattagtactcgcaacagcaaatcaagaaaaaggtcaacgcacaccctttcaagcactggactccatggatgatgcatggagttatattgaatttaaacaatacgtcagaaactcaaaatcactaagtaacaaaaaaaaagactatctactcaccgaggaagatatttcaaagatcgaagtaaaacaaaaatttattgaaagaaaccttgtagacacaagatactcgagccgcgtcgttttaaacactcttcaggaattttacaaaaccaacgactttgataccaagatatctgtagtaagaggccaatttacatcacaactacgacgtaaatggaaaatagaaaaatccagagatacataccaccaccatgcagtagacgcactcatcatagcagcctcctcacaactaagattatggaaaaaacaaaataacccattaatcagttaccgcgaaggacaactagtagatccggaaacaggagaaatcctttccctgacagatgatgaatacaaagaactagttctaaggcccccatacgactattttgtagacacattaaaatcaaaatctttcgaagacagtatattattttcatatcaagtagacagtaaatacaaccggaaaatatctgatgccacaatatacggcaccagaaaggcacaactagggaaagacaaacaagaagaaacatatgtcttaggcaaaatcaaagacatttactcacaaaaaggctacgaggactttattaaacgatataaaaaagatacaacccaatttcttatgtatcacaaagacccacaaacgttcgcgaaagtgatagaggaaatactaaaaacatacccagacaaagaactcaacgaaaaaggtaaggagataccatgcaatccattcgaaaaatacagacaagaaaacgggccaatccgaaaatatagtaaaaaaggaaaagggccagaaataaaatcactaaaatattacgacaataaactggggaaccacatagatatcacaccagtgaattctcaaaaccaagtggtactgcaatcactaaaaccctggagaaccgacgtctatttcaaccctcaaacatcaaaatacgaattaatgggactgaaatactcagaccttagattcgaaaaaggttcaggtagctatggaataagcccagaaaaatacaataaagtcaaagcaaaagaaggagtggacgaagatagtgaattcaaattcaccttatataagaacgacctaatattaataaaagacactgagacgggagaacaacaattattcagatatggatccagaaacgacacatcaaaacattacgtggaacttaaaccctacgaaaaagccaaatttgaaggaaaccaacaattgatgaatctacttggaacagtagctaaaggtggccaatgtttaaagggaataaacaaacctaacctttcaatatataaagtcaaaactgacgtcctaggaaacaaatatttcataaaaaaagaaggagaccagcctcaattaaatttcaaaaaaaaaatatga

SEQ ID NO: 5121 - RNA, 3378 nt, synthetic construct
  misc_feature 1..3378: note = Cas9 variant
  source 1..3378: mol_type = other RNA
atgaccagcaaacaagaaaatttaggagcattaacgttcggacttgacatagggattgcaagtgtgggctgggccgtgctgggcgaaaatagaataatagacttaggggtcaggtgctttgacaaagccgaaacagcaaaagagggagaaagcctgaatctcgcaagacgaatggctaggttattgagacgtagattaagaagacgcgcatggagattaacaaaattagccagattactaaaaagagaaggattgatagcagacgcgaatctgtttaaaaataaaatagagaaaaatacccctgttcccaaaagtagttggcaattaagagtagacgcattagaccgaaaactaaacgccgaagaatgggcaagagtaatttatcatctatgcaaacacagaggattccactggatatcaagagcggaagaaaaagcagctgaatccgattccaaaggagaaagcggaaaagttaaacagggattagccggaacaaagaaactaatgcaagagaaaaattacagaacagcagcagaaatggtactagcagagttcccagaagcacagaggaacaaacaaggagattactcaaaagcattatcaaggatcctcctaggtgatgaattaaagacattatttgaacaccaacgaaaactagattcaccttttgcaacggaaaaattagaagcagcgatattgggaaatggcgacagaaaatcaggcttattttgggcgcaaaacccagcgttagcaggaagtgatttgttaaaaatgttaggttattgtacttttgagaaaaccgaatatcgagcaccaaaagccagcttcacagcagaacgtcacgtatggttaacaagactaaataacctaagaatagtagtagatggtacaacacgaccactaaacgaagcagaacgcagaattgcactattaatgccatatcaacaagccggcgatttcacatacaaacaacttaggactgcgttaactaaagcaggttttctaccagaatcatttaggtatacaggattatcatacgctagtggacaaaaagcaggcgagaaaactaaagaccctgaaagcgctgctctcgttaaattccctgcatggcaagaattacgtaaaacactagaaaagaaagaactagcttcagaatggcaaaagatatcaactgatgcgctagacggaaaaccacagctactagatcaaatagcttgggtgctcagcgtatataaagatgatgacgaagtaaaggccgaattatcgaaacttaatctaccaaacgccgagaaaatgatagacgcactactggatataagatttgacaaattttctaatttgagcttaaaagcattatgtaaaattgtacctttaatggaacaaggtcaaagatacgacgaagctatagcgaatataccagaatacggtcatcacagtcaactacataaagtaggggcaggagaacataaatatttaccacccttctacaaggaacgagataagacaggaagaatggtatttaatgacgacatggatatacccaggaatccagtagttttaagagcattaaatcaagcgcgtaaagtcgtaaatgctttaatcaaaaagtatgattcacctcatgaagtgcatatagaaatggctcgagatttatcaagaccacttgacgaaagaagagaagtcgaaaaacttcaaaaggaatttcgagacaacaacgaaaagggtaaagcacaatttgcacaagacttcaatatagtaggcgcggtaaaagggaaagaatttgagaaataccaactatatcgagaacaacaaggtaaatgcgcctactcaatagaacctatggacattcacagactatttgaacaaggatacgtcgagattgaccacgcactaccatactcaagaagttttgatgacagtaaaaataacagagtcttagttctagcaaaagaaaacagagataaagggaatcgaacaccattcgagtatctcggaggaaaagacaattcagaaccatggcgacaatttgttgcttttgttgagggaaataaagcatatagactggcaaaaagatcaagattactaagaaaagacttcggagataaagaagcaaaggagttccgcgaaagaaacctaaacgacacaagatacatttgtaaattctttaaaaactatgtagaacagtatcttcagctacacgaagactcagaagcaaaacgttgcgtagttctatccggacaaatgacatcgtttctaagggcacgttggggattagtaaaagttaggggtgacagcgaccgacatcatgcactcgacgcagctgtcgttgctgcttgctcacatggaatggttaaaagactatctgactatagcaggaggaaagaacttgaacaggtcagagagggatttgttgatgtagacaccggggagatagtcaatccagcaatgttccaacaagtccaagagcattttcccaatccatggcctcattttagagatgaagtcaaattaagattatcaatggatgacccagctttgttacggagcgaaatggaaaagttcggcacttacacaccggaagcactacaggcactacaccctttatttgtctccagagcacctcaaagaagaaattcaggagcagcacataaagatactatatacgctcaaccgaaaagattagtagcccaaggaggcgtaacacaaaaagttgcacttacaagtttgacattaaaggacctagataaactaatagatccacaccgtaatgataaactatacacagccataagagcacgattagaacaacacggaggtaaaggagacaaagcgttcccaagctctaaccccttacggaaaccagatagtgagggaaatccaactggaccaatagtgcgcggcgtcacaatggtaatagataaactatcaggaatccctataagagggggaatagctaaaaatgactctatggtaagggtagatgtatttacgaaagccaataagttccatttagttccagtctatgtccatcacacagtggctaaagccctacctaatagggcagtagtagctttcaaagacgaagatgagtggacattaattgatgacagctttgatttttgtttttcgttacacccgaacgacctagtacaagtacaacaaaaaggaaaagcaggaatgattggatattatagcagctgccacagaggaacaggaaacattaatttatgggcacatgaccgaaacttacaggtaggaaaagatggaatgatagaaggtattggagtgaaaacagcattgtcactagaaaaattcaacgtcgatgtgctaggcaaccgatacccagcaccaccggaaaaacgaagagatttagcatga

SEQ ID NO: 5122 - RNA, 3378 nt, synthetic construct
  misc_feature 1..3378: note = Cas9 variant
  source 1..3378: mol_type = other RNA
atgacagacagaatctcattaggactcgacatcggggtagcaagcgttggtttcagcgtactagatatagacaaaggaaaagtaatagaactaggagcacgattatttaacgcaacagtcgcggcaggaaatcaagacagaagagacatgaggggctcaagacgactattgaacagaaacaaacagagacgaaaagacgtatctaaattatttcaagaatacggactgttggacaacttcgacagagacaactttcacacagcctttaataacaattggaatccatatgagctacgtgttaaaggcttaacaaaacaactaaataaagaagaactcgcagactcattgtatcaaataataaaaagacgagggataagctatgcattaaaagacgctgacgcaaacgaagacggaacagattactcatcatccttaaaaattaattcgcaagaactcatagaaaaaacgccagcgcaaattcagctacaacgactcaacgattacggcaaagtacgaggcaaagtaatcgtcggagacgacatcgacgaccaaaaagtacttttaaacgtattcccgaccaatgcatacgaaaaggaggcacgccaaataatagctacacaacaacaattttatcccgaaatattaacaggagaatttgtaaaagaatactgtcagatattaacacgaaaacgagactatttcgttgggccaggcaacgaaaaatcacgaacagactacggaatatataaaacagacggaagaacattggacaatctttttgaagaattaatcggacatgacaaaatctacccagacgaactacgagcgtcagcagcttcatacaccgctcaactctttaacgtgctaaacgacctaaataatttaagaatattaagctacgaagacggaaaattaacacaaatagacaaagaaaaaatcatagcagaaataaaaaataataccacagtagtcaacatgttaaacgttataaaaaaagtaaccggctgtcaaaaagacgatatcaaaggattcagacttaatgaaaaagacaaaccagaaatttcatcaatgcctatttacagaaaagcgcataaggatttcctaaaggtaggcatcgatataactgactggccaatagacttcatcgacagactaagctttatattaacattaaacaccgaaaatggagagataagaaaacaaataaacaaaagattagtccccgactttgacttcttaaatgacgatctagtacaactcattatcgataacaaagacagcttcgacataaaaacaaataacaaatggcatcgattttccttaaaaaccatgaacaaactaatccccacaatgatcgaaagaccagtagagcaaatgactctcctcacagaaatgggcctaataaaaaaagatactaaaagattcgaaggaaataaatatctcccatacaaagaaatagctaacgatatatttaacccggtagcgtcaaaatcagtaagagaagctctaaaaatagtgaacgcagttttaaaaaaatatggacatatagaatacatagtaatagaaatgccgagggataaaaatcttgacgaagaacgcaaacaaatagccgacttccaaaagaaaaataaaaaaataaaagacgcagcattcaatgcgttcgtaaaagcagtcggttcaaaaaaaaatgtaaaaattgcactatcaaaaaacaggaaattacaaatgggaatacgattatggcatcaacaacaaggcatcgatccatacaatggggaagaaataaacgcgaacgatctaataagcaacccagacaaattcgaaatagatcacataataccacaatccattagcttcgatgatggaataaataacaagacgttatgcttcgcctcgatgaatcaagtaaaaggacaaaagacaccatacgaatttttaaacgaaggccacggacagggctacgcaaaattcaaagcgatagtctccaagaacaaaaacttctcaaaagctaaaagagataactacttattcgaagaaaacgtctcaaacatcgaaacaagaaaaaggttcttatcgagaaacctagtcgacacacgctatagtagccgagtagttctaaactcactacaagaattttttcacgaaaaaagtgatgacacaaaagtgacagtgataagaggaaaattcacatccaacatgagaaaacattggcacatcgacaaaactagagatacatttcatcatcatgcaatagacgcaagcattatagcagcaacacctttcctccgcatgtggaaaaaaggcagcacaatattccctaccaaaatcaacgaaacatcaatagacatagaaaccggagaaatactcgacgataaaaattttgataaagtaatgtacgaagaaccctattccgggttcataagcgaaataatgaacgccgatgaccgaataaaattcagccatcaagtagacaagaaaatgaatagaaaagtatcagacgcaacaatatatagcacacgtataggaaaactaagtaaagataaaaaagatgcggaatacgtagtagcaaaagtcaaagacatttattcggtagatggatatgagaactttaaaaaagtatacaaaaaagataaaacaaaattcttattatacaagtacgatccacgaacattttcagaattggaaaaaatcgtcatagactatccagacaaaatcgagaaagtccagaccaatggcaaaattaaagcagtagatatcagccctttcgaactatacagaagagataacggaatggtgagaaaatattctaaaaaaaccggacccgccataaaacaactcaagtatctagacaaaaaactaggttcacacatagacataaccccaaaaaacgcaaacaacaaacatgtagtgctacaaagccttaaaccatggagaacagacgtttatttgaaccatgaaactggggaatacgaaatcatgggcattaagtattcagacctgaaatttaacaaaaacgaaggatacggaataaaaaaagacaaatatcttaaaataaaaaatatagagggcgtaagtgaaaactctgaattcatgtttagcctataccgaaaagatcggataaaagtacaagatatggaaacaaatgaatcggttgaattactattctggtcaagaaattttagcaacaagaagtatgcagaactgaaacccataagccaaatagataatgataaagttttacccatatatggaagaggtagacttataaaaagactaatcccaaaaaattgtaagatctggaaagtcaacacaagtatattaggtgacacatactacttagaaaaagaaagtaactatccccaaaagatactagattga

SEQ ID NO: 5123 - RNA, 3381 nt, synthetic construct
  misc_feature 1..3381: note = Cas9 variant
  source 1..3381: mol_type = other RNA
atgaacggcttagtactcggtttagacattggaattgcctcagtaggtgtcggcatccttaataaagaaacgggcgaaataatacacgccaatagtagaattttccccgctgcgacagccgactcaaacgtggaaagaaggggattcagacaaggaagaagattaggcagaagaaagaaacacaggtcagcgcgactaaataacttatttgaagagttcggattcataacagacttttccgcaataccactcaatctaaacccctatgcgctacgagtaaaaggactatcagaagaactaacaaatgaggaactattcatagccctaaagaacattataaaacgaagaggaatatcatacctagacgatgcaagtgaagatggtgaaactgcatcgaatgaatatggtaaagctgtcgaagaaaatagaaaactattagcagacaaaactcccggacaaatccaactagaaagattcgaaaaatacggtcaagtgcgtggagattttacggtagtggagaacggagaaaaccataggttaataaacgtcttctcaacctccgcatacaagaaagaagcagaaagaatattaagaagacaacaagagttcaacgtccgaatctcggacgagttcatcgaggcttacctaacaatattaacaggaaaaaggaaatattaccatggaccagggaatgagaaaagccgaacggattacggacgattccgaacagatggaaccacactcgacaatatatttggcattttaattggcaaatgcacattctacccagatgaatatagagcagcaaaagcaagctatacggcacaagaatttaacctacttaatgacctaaataacttaacagttcctacagaaactaagaaactctcacccgaacaaaaacgccagatagtcgaatatgcaagaacagcgaaaacactcggcactcctacactactaaaatacatagcgaaattagtggacgggtctatagatgatataaaaggctacagaatagacaaaagtgacaaaccagaaatgatgcatacgttcgatgcctatcgcaaaatgagaactctagatcttgttaacatagatgcattatcgagagaaacacttgacgacctagcacacatattaaccctaaacacagaatctgaaggcatcctagaagcactaaacagtaaaatgccaagtacatttactaaagaacagatcgatgaattgatacaattcagaaagaaaaacagtgcagtcttcggcaaaggatggcacaactttagtctaaaactgatgaacgaactaatttccgaactttatgaaaccagcgaagaacaaatgactattctaaccagacttggaaaacagagatcaagagaaatatcaaaaagaaccaaatatatagatgaaaaagaacttaccgaagaaatatacaacccagtagtagccaaaagcgttagacaagcgataaaaataataaacgaagcgacaaaacgctatggaatctttgataacattgtaatagaaatggcacgagaaaacaacgaagaagacgccaagaaagactacataaaacgacaaaaagccaatcaagatgagaaaaacgcgtcaatggaaaaagcagcatttcaatacaatggtaagaaagaactaccagacagtatatttcacgggcacaaagaattagccacaaaaataagactatggcaccaacaaggcgaaagatgtctctacactggcaaaaacatctcgatccgagatttaatacacaacccacatcaatacgaaatcgatcatatattaccattaagtttatcattcgacgacggactagccaataaagtattagtactagctacggcaaaccaagaaaaaggacaaagaacacccttccaagctatagactcaatggatgacgcatggtcttatagagagttcaaacaatatgtaagaaatagcaaatcactatccaataaaaagaaagattacctacttacagaagaagatatcagtaaaattgaagtaaaacaaaaatttatagaaagaaatttagtagacacaagatacagttctagagtagtcctaaacacacttcaagaattttacaaaaccaacgactttgatacaaaaatttccgtagtccgcggacaatttacatcacaattaagaagaaaatggaaaatagaaaaatcaagagatacataccaccaccacgcagtagacgcccttataatagcagccagcagccaacttcgattatggaagaaacagaacaaccccctgatatcatacaaagaagggcaatttgtagacccagaaacaggagaaatattaagcctcacagacgacgaatacaaagaactcgtatttaggccaccctacgactactttgtcgacacacttaaaagcaaatcgttcgaagacagtattctatttagttaccaagttgatagcaaatacaatagaaaaataagcgacgccactatatacggaacccgaaaagctcaattaggaaaagataaacaagaagaaacgtacgtactgggaaaaataaaagacatatacagccaaaaaggctacgaagactttataaaaagatacaataaagacgaaacacagttcctaatatatcacaaagatccacaaacattcgaaaaagttatagaagaaatactaaaaacctatccagacaaagaactaaacgaaaaaggaaaagaaataccttgcaatccgttcgaaaaatatcgccaagaaaacggaccaatacgaaaatactcaaagaaaggaaaaggtcctgagattaaaatactaaaatattatgataacaaacttggtaaccacatagacataaccccagtcaattcacaaaaccaggtagtcctccaaagcctaaaaccttggcgaacagatgtttacttcaacccaagaacatccaaatacgaattaatgggcctaaaatatagtgatctcagattcgaaaaaggaagcggttcatacggtataagtccagaaaaatacaacaaagtaaaagcaaaagaaggggttaacgaagactcagagttcaaattcaccttatataaaaatgaccttattctaataaaagacacagaaaccggcgaacaacaattattcaggtacggctcaaggaacgatacttcgaaacactatgtagaattaaaaccttacgaaaaagcaaaattcgaaggaaatcaacaactaatgaatctgctcgggacagttgctaaaggagggcaatgcttaaagggaatcaataagccaaatctatcaatttacaaagtaaaaaccgacgtgttaggcaataaatacttcataaagaaagaaggagatcaaccacaactaaactttaaaaagaaattttga

SEQ ID NO: 5124 - RNA, 3381 nt, synthetic construct
  misc_feature 1..3381: note = Cas9 variant
  source 1..3381: mol_type = other RNA
atggcgagtaaacatgaaaatctcggagcattaacatttggattagacatcggcatagcgagtgttggatgggctgtactaggagaaaatcgaataatagatctaggagtacgatgttttgataaagctgaaactgcgaaagaaggtgaatcattaaacctagctagacgaactgcaagactattacgaaggagactaagaaggagagcatggcgtctaacaaaactagcaagattactaaaacgagaaggattaatcgcagacaccaatgtttttcaaaaaccattcaatctaaaagacgcaaacgaaaaaggacttagtttctggcaactaagagtagatgctctagacagaaaattatccgccgaagaatgggcaagagttatatatcatttatgtaaacaccgaggttttcattggataagtcgcgcagaagaaaaagccgccgagggcgacagcaaatccgagggaggaaaagtaaaacagggacttgcagggactaaaaagctaatgcaagagaaaaattatagaacagcagctgaaatggtattgacagagttcccagaagctcaaaggaataaacaaggtgactatagtaaagccctgagcaggatacttttaggtgatgaaatgactcaactattcaaacaccaacgagaattaggaaacccacatgcgaccgaaaaattagaagctgcaattctaggaaacggagaccataagagcggattgttttgggcacaaaatccagccctagcaggaaacgacttacttaaaatgcttggacattgtaccttcgaaaaagcagaatatcgagtaccaaaagcatcatttacagctgaaaggcatgtttggcttactagattaaacaatttgcgcattgttgtcgatggaacaacaagacctttaaatgaagccgaaagacatttagcattattaatgccttaccaacaggcgggagatctaacatacaaacaattaaggactgcactaactaaagcaggatatctgcccgaatcgttccgatatacaggtttagcgtacgcatcagggcaaaaagcagatgaaaaagcgaaagacccagaaagcgcacctctagtaaaattaccagcatggcatgaactaaggaagacattagagaaaaaggaactagctagtgaatggcagaaaataagctctgatgcattagacggaaaaccacaactattagatcaaatagcatgggtccttagcgtatataaggatgatacagaagtcgaagcagaattatgcaaactaaatttacctaatgccgagaaaatgatcgacgcactgctcgacataaggtttgataaattcagtaacctaagccttaaggctttaagacaaatagtacccctaatggaacaaggtcagagatatgacgaagcagttgctaatatacctgaatatggacatcattctcaactacatgaagtaggagctggggaacataagtacctaccacctttttacaaagaacgagataaaacaggtagaatggtatttaacgatgatatggacataccaagaaaccctgtcgtactaagagcacttaaccaagcacgaaaagtcgtgaatgctttaataaaagaatacggcagtccccacgaagtacacatagaaatggcacgagacctaagtcgcccattagatgaaagacgagacgtagaaaaattacaaaaagaatttagagatagaaacgaaaaagacaaggctttatttgcacaagatttcaacattgtaggagctgtaaaaggaaaagaatttgaaaaataccagttatatagagaacaacaagggaaatgtgcatattcaatagaaccaatggatattcacagactttttgaacaaggatacgttgaaatagaccacgcattaccatatagtagatcatttgatgatagcaaaaataacagagttctagtattagcaaaagaaaatagagataagggtaatagaacaccctttgagtatcttggtggaaaagacaactcagaacgatggagacaatttgttgcattcgtagaagggaataaaagctatcgattagccaaaagaagtagactgttacgtaaggactttggaaaagacgaagccaaaggctttagagaacgaaacctaaatgatactaggtacatttgtagattctttaaaaactacgtagaacaatacctacaacttcacgaagatagtgatgccaaaaggtgtgtagtactaagcgggcaaatgacgtcattcctaagagcaagatggggtctagtaaaagtcaggggagatagcgatagacatcacgcacttgatggggcgatagttgcagcatgttcacacagtatggtaaaaagactaagtgactattcacggcgaaaagaattagagcaagttcgagcagggttcgtcgacgtagatacaggagaaatagttaatccagcaatgtttcaacaagtacaagaacacttcccgaacccctggccacatttcagagatgaagtaaaattacgactaaacgtcgacgatccagcattattacactctgaaatgaacagattcggtacatattctccggaagccttaaaagctctacgcccattgtttatatcacgggcaccgcaaagaagaaatagtggtgcagcacataaggacacgatatatgcgcaaccagaacgattagtagcacaaggtggtgtaacccagaaagtcccactaacctctttaacactaaaagatttagataaacttatagacccacatcgaaatgaaaaattatactccgccataagaatacgtctcgaacaacatggaggaaagggcgataaggctttccctgcatctaatcccttaagaaaacctgatagcgaaggaaaccctaccggaccaatagtaaggggagtcacaatggttatagacaaattatctgggatacctataagaggaggtatagctaaaaacgattcgatggtacgagtagatgtatttactaaagctggtaaatttcacctagtccccgtttacgtacatcacgcagttgcaaaagtactcccaaatcgagccgtagtggcatataaggatgaaacagaatggactctaatcgatgatggctttgatttctgctttagtatgtatcccaatgatctcctgagaatcaaactaagaaatgctagtcacttaggatactatgcaagttgtaacaggtcaacgggagcaataaatttgtggagccatgaccgaaaccaacaagtcggaaaagacgggatgatagagagcataggtgtaaaaaccgcactgaatgtggaaaaactaaacatagacgtactaggtaatagatacccagcgccacctgaaaaacgacgagacttagcgtga

SEQ ID NO: 5125 - RNA, 3384 nt, synthetic construct
  misc_feature 1..3384: note = Cas9 variant
  source 1..3384: mol_type = other RNA
atgagcgatctcgtcctgggtttagacatcggtatcgggagcgtaggagtaggtatacttaacaaagtaacaggcgagataattcataagaactcaagaatctttcctgcagcccaagcagagaataatgtagaaaggagaatcaaccgccaaggaagaagattaaccagacgaaagaaacatcgcagggtaagactaaatcacctattcgaagaatccggactaataaccgattttacgaacgtaagtataaatttaaatccatatcaactacgggtaaaaggactgacagatgaactaagcaatgaagaactattcatagcactcaaaaatatggtaaaacacagaggtatttcatacctagatgacgcaagtgacgatggaaatagttccgttggagattatgcacaaatagtaaaagaaaattcaaaacaactagaaacaaaaacaccgggccaaatacaactagaaagatatcaaaaatatggacaattaagaggagacttcacagttgaagaagacggaaagaaacacagactaataaatgttttcccaaccagtgcctacagagccgaagccttacggatacttcaaacacaacaagaatttaatccacagataactgatgaatttattaatagttaccttcaaatcctaactggaaaaagaaaatactatcacggaccaggcaatgaaaaatcccgaactgactacggaaggtatacgacaaagaaagactctgaagacgaatatatcacactagataatattttcggaatattaataggcaaatgcacgttttacccagaagaatatagggcagcgaaagcctcatacactgcacaagagttcaacctcttaaacgatctaaacaatttaaccgttcccactgaaactaagaaactcagcgaagaacagaaaaatcaaatcatcacaaacgttaaaaatgaaaaagcaatgggacccgcaaaactcttcaaatacatcgcaaaactactatcctgtgatgtagcagatataaaaggctatcgaatcgacaaaagtgataaagcggaaatacacacttttgaagcctaccgaaaaatgaaaacgttagcaaccatcgatatagaacaaatggaacgagaaaacttagacaaattggcttacgtcctaacactaaatactgaaaaagaaggcatacaagaagccttagaacacgaatttgcagacggaaccttttcacaagaacaaatagacgagctagttcaattccgaaaagcaaattcatcaatattcggaaaaggatggcattcattctcagtaaaactaatgatggaactaataccagaattatatgcaacaagtgaggaacaaatgacaattttaactagactaggaaaacagaaaacaacatcatctagtaacaaaacaaaatacatcgacgaaaaacaacttacggaagaaatttataacccagtagcagcaaaatcagtacgccaagctataaaaatagtaaacgcagccatcaaagaatacggagacttcgacaatatagtcatagaaatggcgagagaaaccaacgaagacgacgaaaagaaagcaatacagaaaatacaaaaagcaaataaagatgaaaaagatgcagcaatgctaaaagcagcaaatcaatataatggtaaagctgaattaccacacagtgtattccatggacataaacaactagccacgaaaatacgattatggcaccaacaaggagaaagatgcttatacactggaaaaacaatatccatccatgaccttataaataactcaaaccaattcgaaattgatcacatactcccattaagtataaccttcgatgactcactagccaacaaagtcctagtttatgccacagcaaaccaagaaaaaggccaaagaacaccatatcaagcgttggactcaatggacgatgcgtggagcttcagagaactaaaagcattcgttagagactcaaaagcactaagcaataaaaagaaagaatacctacttacagaagaagacatatccaaatttgacgttagaaagaaatttatcgaacgaaacttagtagacacaagatacgccagcagggtagtacttaacgcgttacaagaacattttagagtacacaaaacagatacaaaagtaagtgtagtcagaggacaattcacaagtcagctaagaagacattggggtatagagaaaactcgagacacatatcaccaccacgcagtagatgctttaataatagcagcttcctcacaactaaacctctggaagaaacagaaaaacactctagtgtcatatagcgaagaccaacttttagatatcgaaacaggagaactaatctcagatgacgaatacaaagagtccgtatttaaagcaccatatcaacattttgtagatacactaaaaagcaaagaatttgaagattcaatactcttctcctaccaagttgacagcaaattcaatagaaaaatttcagacgccaccatatacgccacaaggcaagctaaagttggtaaagacaagaaagacgagacatacgtactaggaaaaatcaaagacatatatagtcaaacaggatacgacgctttcataaaaatatacaagaaagacaaaagcaaatttctaatgtaccgacacgatccacaaaccttcgaaaaagtaatagaaccaatactagaaaattatcctaataaagagctcaatgaaaaagggaaagaagtaccatgtaatccattcctcaaatacaaagaggatcacggatacataaggaaatacagtaagaaaggaaacgggcccgaaattaaatcacttaagtactacgattcaaaactaggtaatcacatagatattactcctaaaaattcaaataataaggttgtattacaaagcgtatctccatggcgagcagacgtatactttaacaaaacaacaggaaaatatgaaatcttaggactcaagtatgcagacctgaaatttgaaaaagggacagggacatataaaataagcgaagaaaaatacaacgacataaaaataaaagaaggcgtagattccgatagtgagttcaaatttacactttacaaaaatgatctactattaatcaaggacaccgaaacaaaagaacaacaattattcagattcttatcaaggactatgccaaacgtaaaacattatgttgaactaaagccctatgataaacaaaagttcgatgacaatgaagaactaattaaaatcctcgggatagtagcaaaaggaggacaatgcaagaaaggagtatcaaaaccaaatatctctatatacaaaatcagaactgacgtattaggcaatcagcacataatcaaaaatgaaggtgacaaaccaaagctggatttttga

SEQ ID NO: 5126 - RNA, 3384 nt, synthetic construct
  misc_feature 1..3384: note = Cas9 variant
  source 1..3384: mol_type = other RNA
atgaatggtttagtccttggcctagacatcggaatagcatcagtaggagtaggaatcttagaaaaagactctggtaaaatcatacacgcaaattcgagaatcttccccgcagcaacagcggacaataatgttgaaagacgtacatcccgacaagcacgccgacttaatcgtagaaagaaacatcgaagtgtaagattacatgaccttttcgaagaatacgggctcctaacagatttttcaaaagtgtcaatcaacctaaacccctatcaaatacgagtacaaggactagacaaaaggcttactaacgaagaactcttcattgcactgaaaaacattgtaaaaagaaggggcataagttacctagacgatgcatcagaagatggaggagctgttagttctgactatggaaaagcagttgaagaaaacagaaaactattagcccaacaaaccccaggacaaatacaactggacagattcgaaaaatatggacaagtaagaggagactttacagtagtagaaaatggggaaaaacgaagactaataaatgtgttcagcacaagcgcctacagaaaagaagcagaaagaatacttaggaaacaacaagaatttaacaataaaataaccgaagggttcatagaagattacttgacaatcttaaccggaaaacgcaaatactatcacggacccggaaatgagaaaagcagaactgactatggaagatacaccacaaagaaagactcccaaggggaatatataacactagataatattttcggcattttaatcgggaaatgcacattctaccctgatgaatatagagctagcaaagcatcatatacagcccaagaatttaacttattgaacgacttaaataatctaacagtacctacagaaacaaagaaattaagtgtagaacaaaagaaaaccatagttgaatacgcaaaaactgccaaaaccctaggggcctcaacgctactaaaatacattgccaaactcataggagtctctgtagaccaaatccacggttacaggatagatcctaatgaaaaaccagaaatgcacactttcgaagtatacagaaaaatgcaatcactagaaacgattagagttgaagaattaccgaggaaggttatagatgaacttgctcacatattaacattaaatacagaacgagaaggaattgaagaggccataaatgcaaaactgaaagatatattttctcaagatcaagttctagaattagtacaattcaggaaaaacaattcttcgttattcagtaaagggtggcataacttctcactaaaattaatgatggaattaataccggaactgtacgaaacatctgaggaacagatgacaatacttacgagactaggaaaacaaaaatcaaaagaaacgtccaaaagaacgaaatacattgatgagaaagaattaacagaggaaatatataacccagtcgtagcaaaatcagttagacaagccattaagataataaatgaagccacgaaaagatacggaatatttgataatatcgtaattgaaatggcacgagaaaataatgaagaggacgcaaagaaagaatacattaaacgacaaaaagccaacttagacgagaaaaacgcagctatggaaaaagcagcctttcaatataacggaaagaaagaattacccgataacgtcttccacggccataaagagttagcaacaaaaatcaggttatggcatcaacaaggcgaaaaatgcctgtataccggtaaaaacataccaatcagcgatctaatacaaaaccgatacaaatacgaaatagatcacatactaccgctcagcctatcatttgacgactcactatcaaacaaagttctcgtattagccactgcaaatcaagagaaaggacaaagaacaccgtttcaagcactagactcaatggattatgcatggagctatagagagttcaaatcctacgttaaagactctaaattattgtcgaacaaaaagaaagattacctattaacggaagaagatataagcaaaatagaagtgaaacaaaaattcattgaaagaaatctagtagacacaagatattccagcagagtagtactgaatgcactacaagacttttataaagaacatcaattcgataccacaatatccgtagtaagaggccaatttacctctcaactaagaagaaaatgggggatagaaaaatcccgcgagacatatcaccatcacgccgtcgacgccttgataatagcggcatcttcacaactaagattatggaagaaacataataaccctctaataagttacaaagaggaacaatttgtcgattcagaaactggggaaataatctcaatgtcagatgacgaatataaagagttagtattcaaagccccatatgaccacttcgtagatacactaaaatcaaagaaatttgaggactccatactattctcataccaagtagacagtaaatacaatcgcaaaatttcagatgctacaatatacgcaactagaaaagcaaaactagataaagataaaagtgaagaaacatacgtactaggaaaaataaaagatatatatagtcaagccggttacgataccttcataaaaatatacaataaggataagtccagattcctaatgtatcacaaagatccgcaaacattcgaaaaagtcatcgaagaaatacttagaacctatccatcaaaagaactaaacgagaaaaataaggaagtcccttgcaaccccttcgaaaaatacagacaagaaaacggaccgataaggaagtatagccgaaaaggaaacggacccgaaatcaaatcactaaaatattatgataataaactaggaaatcacatagatattacacccaatgaatctatgaaccaggttgtccttcaatctttgaaaccttggagaacggacgtatttttcaatcaccaaacggaaaaatatgaactaatgggattaaaatatagtgacctcaatttcgagaaaggaagcggcaaatactcaataagtttagaaaaatacaacagcataaaaatgaatgaaggcgtctcagaagaaagtgagttcaaattcacattatataaaaatgatcttatactaataaaagatgcactcacaaaagaagcacaaatatttagatacggcagcaggaacgacacatccaaacactacgttgaactaaagccctatgatatgtcaaagttcgaaggagacgaaagactaataaaagtattaggaacagtagcaaaaggaggaaggtgtataaaaggactcaacaagaaagacatatctatatttaaagtgaaaacggacgtactaggcaataaacactttataaagaaagaaggcgaagaacctaaattaaaattctga

SEQ ID NO: 5127 - RNA, 3387 nt, synthetic construct
  misc_feature 1..3387: note = Cas9 variant
  source 1..3387: mol_type = other RNA
atgacaaaacttggcaaaccttacgggataggagttgatataggatcgaactcaattggtttcgcagcagtagacgaaaattcacatttaatacgtctaaaaggtaaaactgttatcggagctcgattattcgaagagggtaaagcggcagcaaaacgcagagcaggtagaacaaccagaagacgattatcaagaaatcgctggcgtctcagcttcttaagagactttttcgagtcacatatcactcctacagatccaaactttttcatgagacaaaaatatagtgagatcagcccaaaagataaagcacgatacaaatacgaaaaacgactatttaatgatagaaccgacgctgaattttatcaacaatatagcactatgtaccacctacgaaatcgactaatgacagatcctagcagagcagacgtacgagagatatacttcgcaatacatcatatactaaaaagtagaggacattttctaacgcctggagatgcaaaagatttcaacacgaacgacgtagcactagatgaaatattccccgcgctccaagacgcatatgcacaagtctatcccgacctagggattaccttcgacgaggataaagctaatgagttcaaaacgatactgttaaacgaaatagctacatcaatcgacacccaaagagctttagtaaaactgcttctagcagaagaagatgacaaagatatactaaaacaacaaaaacaagttcttactgagttcgcaaaagctgtagtcggacttaaaacaaaactgaatcttgcactcggcactgaagtagactcatctgaagcaacagcatggaatttttctttaggccaattagacgataaatgggctggaatagaatcagctatgacagacgaaggaaccgaaatattagaccaaattagagacctatacagagccagattactcaacggaattgttccaaccggaaaaacattaagtcaagcaaaggtagacgattacacacaacatcacgaagacttacaactatttaaggcatacctaaaacaactagaagacgatggcacagcaaaagctataaggcaactatatgatagatatatagacggagatgatgcagcaccgttcttaagagaaaacttcgttaaagcactgaccaaggatgtaactgcccacccaaatacaaaaagtccagaactattagaaagattagctcaacctgattttatgcttaaacaaagaaacaaagcgaacggggcaataccagtccaaatgcaacaaagagaattagaccaaataattaaaaatcaagccgtatactatgactggttagccgcaccaaatccagtcgaaaaacatcgaaaatctatgccatatcaattagacgaactactaaatttcagaataccatattacgttggaccactcgtaacagcaaaagaacaaaaggcagcacaaggcggagtattcgcatggatggtaagaaaagatccagaaggaaatataacaccatataattttgacgaaaaagtagaccgagaagccagcgccaacaccttcatccaaagaatgaaaaccacagatacatacctgataggtgaagatgtactacctaaacaatctctactctatcaaagatacgaagtacttaacgaactaaacaatgtaagagtaaacaatgaaaaattaagtatcgaacaaaaacaacaagttataagagaactattcgaacgccacaattctgtaactatcaaacagttcgcagaaaatctcagagcacatggagactatgcacatataccagaaataagaggtttagcagatgaaaaacgattcttatcatcactctcaacatatcgacaactaaaatctctgctgccagaagcaatagacgatcctgcaaaacaagcggatattgaaaacataatagcatggtcaacagtattcgaagacgcagctatatttaaaacgaaattaaaagaaataagttggctaggatcagaagccataacaaaattaagcaatatacgttatcggggatggggtcaattttcccgaaaattccttaatggtctgacactaggcaatggacacaccataattcaagaattactgctaagcaccaacaacttaatgcaaattttaacggacgaaacactacaaaagaaaatgacagaactcaatgcagacaaattaaaaacagctaatataaacgatgcaatcgataatgcctacacttcacccagcaataagaaagcactccgtcaggtgttacgagtagtagatgatataaaaagagcagcagatggacaagatccatcatggctatacgtagaaactgcagatggcggcggcactcctggtaaaagaactagagcaagacaacaccagttacaagaaatttacgcaaacgctgcacacgaactaattgatacagcagtccgtggagaactggaagataaaatctcggataaagcagatttcaacgacagattagtcctatatttcatgcaagggggaagggatatctacacaggagcgccacttaacatagaccaactttcgagttatgacattgaccacattctaccacagagcttaataaaagacaatagtctagacaatcgagttctagtacacgccataataaatagagagaaaaacgctacatttgcaagtacaatctacgcacaaaagatgaacgcaacttggaggcaatggcatgaagcaggactaataagtggaagaaaactaagaaatcttcaaatgagaccagaccaaatagacaagtatgcatctggatttgttgctcggcagctagtagaaaccagacaaataatcaaactaacagaacaaatagtagcagcacaataccctgacactaaaataattgctgtaaaagccgggctcagccaccaattaagagaagaattagaatttcccaaaaacagagacgtaaaccactaccatcatgcatttgacgcctttctagcagcccgcatcggcacatatttattaaaaagatttccaaatctccaagcatttttcacatatggtaaattcacaaaagcagacgtcaaaaagttaagagggtttaatttcatccgtgatataacacatgcagaagataaaatagtagcaaaagatacaggtgaagtcgtttgggacaaacaaagagacgtagatgaattagacagaatatacaacttcaagagaatgctaataacgcacgaagtaagattcgaaacagcggatctattcaagcaaacagtatatggagctagggactctaaagaagcaggaggctcaaaacaactaatcccaaagaagaaagatattcaactaatcttcatgggtgcaataagtgagagaactagacctatactgcctttgtga

SEQ ID NO: 5128 - RNA, 3387 nt, synthetic construct
  misc_feature 1..3387: note = Cas9 variant
  source 1..3387: mol_type = other RNA
atggatgaaaaaatggattatagaataggccttgacatcggaatagcatcagtaggatgggcagttttacaaaacaatagtgacgacgaaccagtaagaatagtagatttaggagttaggatctttgatacagcagagatacctaaaactggtgagtcactagcagggccaagaagagctgcaagaaccacgcgccgaagattaagaagaagaaaacaccgactggacagaataaaatggctcttcgaaaatcaaggtctaataaatatagatgactttttaaaacgatataatatggcaggactaccagacgtatatcaattaagatacgaagcactagatagaaaactaaccgacgaagaacttgcacaggtattattgcacatagctaaacacagagggtttaggtcaacgcgaaaagcagaaacagcagctaaagaaaacggtgcagtattaaaagcaacagacgaaaaccaaaaaagaatgcaggaaaaaggatatagaacagtcggagaaatgatatatctggacgaagcttttcgaatcggttgcagctggagtgaaaaaggttacatattaactccaaggaacaaagcagaaaactatcagcacacaatgctgagagcaatgctagtagaagaagttaaagaaatattctctagtcaaagaagactagggaacaaaaaagcaactgaagaactagaagaaaaatacctcgaaatcatgacatcacaacgaagttttgacctaggcccaggaatgcaaccagacggaaaaccgtcaccatacgcaatggaaggtttttcagatagagtaggcaaatgtaccttcttaggtgaccaaggggaattaagaggggcaaaaggaacatacacagcagaatacttcgttgcgcttcaaaaaataaaccacaccaaattagtcaatcaagacggagaaacaagaaacttcacagaagaagaaagacgagcgcttaccctactactatttacccaaaaagaagttaagtatgcagcagtacggaaaaaactaggattgcctgaggatatactattctataatctaaactacaaaaaagcggcaacaaaagaagaacaacaaaaggaaaatcaaaacacagaaaaagctaaattcataggaatgccgtattatcacgactacaaaaaatgcctagaagaaagagtaaaataccttactgagaatgaagtcagagacctatttgatgaaataggcatgatactaacatgttacaaaaatgacgattcaaggacagaaaggctagctaaactaggtctggtaccaatagagatggaagggttactagcatatacacctacaaaattccaacatttaagcatgaaagcaatgcgaaatataataccattcctagaaaaaggaatgacatacgataaagcatgtgaggaggcaggttatgatttcaaagcagactcgaagggaacaaagcaaaagctattaacaggggaaaatgttaaccaaacaatcaatgaaataacaaatccagtagtaaaacgatcagtatctcaaactgtaaaagtaataaacgcaataataagaacttacggaagtcctcaagcaatcaatattgaattggcaagagaaatgtcgaagacattcgaagaacgaaggaaaataaaaggggacatggaaaaaagacaaaaaaacaatgaagacgtcaaaaagcagatacaagaactaggaaaattatcaccaacaggccaagacatcttgaaatacaggctctggcaagagcaacaaggaatatgtatgtatagcggaaagactattccgttagaagaattgttcaaaccgggctatgacatagatcatatactaccctattccataacatttgatgacagcttcagaaataaagtattagtaacaagccaagaaaacagacaaaagggaaaccgaacaccatatgaatatatgggaaatgacgaacaaagatggaatgaatttgaaactcgtgtgaaaacgacaataagggattacaagaaacaacagaaattacttaaaaaacacttcagcgaagaagaacgaagcgaattcaaagaacgaaatttaaccgacactaaatatatcaccactgtgatatacaacatgataagacaaaacttggaaatggctccattgaaccgaccagaaaaaaaaaagcaagtgagggctgtcaatggggcaataacagcatatttgcgaaaaaggtggggacttcctcaaaaaaaccgagaaacagatacacatcatgccatggacgcagttgtcatagcttgttgcacagatggaatgatccaaaaaattagtagatatacaaaagtccgagagcgatgttattctaaaggaacagaatttgtagatgctgaaactggcgaaatattccgaccggaagattactctagagcagaatgggacgaaattttcggagtgcatataccgaaaccatgggaaacattccgtgctgaactagatgtccgaatgggagatgacccaaaaggatttttagacacacattcagacgtagccctagaattagactacccagaatatatttacgaaaatctacgacccatattcgtatcaaggatgccaaatcataaagtaaccggtgctgctcatgcagacacaatccggtccccaaggcactttaaagatgaagggattgtactcacaaaaacagcattaacggatttaaaactggacaaagacggtgagattgatggctattacaatcctcaatctgacctacttctatacgaagcacttaagaagcaattactattatatggtaacgacgcaaaaaaagctttcgctcaagactttcataaacctaaagcagacggtaccgagggtccagttgtccgtaaagtcaaaattcaaaaaaaacaaacgatgggagtatttgtcgacagtggaaacggaatagcggaaaatggcggtatggtccgtatagacgtatttcgtgttaatggaaagtattattttgtacctgtttacacagctgatgtcgtaaaaaaagttttaccgaaccgtgcgagtacagcaaataaaccttatagtgaatggagaacaatggaagataaagatttcctattcagcttgtatagtcgagatttagtacacattaaatcaaaaaaaggcatacctataaaaaatgtcgacggatctctcggagaaagtaaagaagtttacgcctattatataggagcagacatctctggggcaaaaatagagggaaaagcacatgatagtagatatacatttagaggaatcggagtacaaaaactcgaattaatagaaaagtgccaagtagatatattaggacacatatcaacagtcaagaacgaaaaacgcatgggcttctcatga

SEQ ID NO: 5129 - RNA, 3387 nt, synthetic construct
  misc_feature 1..3387: note = Cas9 variant
  source 1..3387: mol_type = other RNA
atgaacgataaaaatcaaaaatatagattaggtctagatttaggtacaaattccataggatggtgcatatactcattagatgtaaacaacaaacccgaaactcttatagacatgggagttcgaatattcagtgacggcagagacccaaaaacaaaagaaccacttgctgtagaaagaagaacagcaagagggcttagaagaatacttcatcgcagaaaactaaggagaagacaaatgtttagacttttacaagaacaaggactcatgcccaatgatgcaagtgaagcagcggcattaaaatcactaaatccatacgaactaagagtaaaagcattggataccaagctagaaccatatgaattaggccgtgctttatttaatctctcagtaagaagaggctttaaatcaaatcgaaaagaagcggtccaagaaaaagaaaaagactcccaaaacgacgctaagagtcaaaatgaaaaatgcgaacatttagcaaaagcaatcaaagatagtgggtgtagaacactaggcgagttcctatggaaacataaaaacactgaaactcaacaaacagaaaatgacgcaagaaacataggaatgcgctttgtaccgggtagaagtaactactatcccacgagacgaatgtacgtagaagaatttgatgctataagaaaagcccaagaaccctactactcaggggtaaactgggacgctctccacgaaaagctattttatcaacgaccgcttagagcccaagaacgaggcaaatgcagatatatgccagacaaagagagaacatttaaagcaatgccatgctcacagaaaataaggatactgcaagaagtatacaacatggattatattgacgaatacggaaaaactatacctttagaagaagcacaaacagacagccttatcagtcttctagacaaaagagaaaaactatccttcaaagcaatgaagaaagaattaggaatagacgaatcatgtacatttaatctggagagaggaggtcgagaatacttacaaggaaacgccgcagccgtaaaacttagaaataagaaacgtttcggagaactatgggattcactaagtctcgccaaacaagacgcaatagtagaaaaactcataacagctgatgaagacgccgaaataataagcatgttagcacaatacaacttaacagatgaacaaaagaaaaacatagccgtaactgtactgccctcaggaacggccatgctatgcaaagaagtgacagagatgcttgttcaaaagatggaacaaaataaaattccactcacagttgcagtacaaatgctgggatacacctacgctgatcaatcagtaagagaagaagacacattaccatattacggagcaattctcaccgggagcacaatgggtgctcacccagaagcagacgaatcagaaccggaactaaaatacggaaaaataagcaatcctacagtacacgtagcacttaatcaaactagaacagttgtaaatgcactaattaaagcatacggaaaaccacaacaaatagtagtcgaactctcaagagatttaaaagcatcaagggaagcaaaagcaagaatacagaaaactataaccatgaaccagaaaaggaacgaaagagacaacaaaaatataactgatataacaaaaatcccctacccaaacagaaacgacagactaaaatatcgactttgggaagaattgggatcaggatctaacagctttagtagaaaatgcctatattgcggaaaaccgatatctggatcagaaattttcacagaaaatatagagatagaacatattttacccttcggacgaacactattcgacggagagacgaacaaaactgtagcacacactgactgcaatagagataaaggagaccgatcaccattcgaagcatttggaagctcaccgaatggatacaactggcatgaaatatgtgcacgggcaaactcccttaaaaacccagctaaacgtacgttattcgccgagaacgccatggaaaaatttgaaaaagacaactcattcatacaacgacaactaacagataacgcatacctatcaagaagcgcactcaggtatttacgatgcatttgtaaagacgtctggtcaataaatggaggtatgactaaacttctacgcgacaaatggaatatagattccatattgaaaagaaaaatagatgatcccgaaatagcacatttcgaacttaaaaatgaccaaataggtcaatacaagaaaaataggtatgatcacagacaccatgccttagacgcgtcagtaatagcattaatagacagagctatggtacaagaaatctcacaactaaacaaaataaggttgaaaaaccgaatagaagcaccacaaatgccagtactaaggtcggaacttatcgagaaagtaaaacacatcaccgtaagttttaaaccagatcatggccggcaaggtaaactatcaaaagaaacactactaggaaaaattaaaaagatcgaaaaagtggacattgatagcatacaaaccgacgacatagcttcaatcaaagatgatgcaataagaacccgatttgaaacaaaaagaagagaattaggagatataacaaaagcaaaagcagcattaaaaacagaatttccaaaacttgatgtatttaagacatattatgtttcacgcacgcccatagtcagtctaacagagaaaaatataaattcaatagtagatgagaaaataaaagaaaaactcaaaactttcattaaagaacacgccgatttatcatttgcagaacaactacaaaaattctctgaaacagaatggataggcaaaccgtcggccgcaggaaaaccaggtaagaaatatagaatagagaaagtcagatgcataaactggggccaaacaccaataacaataacaagtagtgcagtaccccggtatctatgcccagaagactatctcgctgcagtagtttggcaaataccgagtaaaaagaaagacacagaacccgaatataaagcaacatttttaagacgagatgagttcgatgtaaataacaaaccaaagaaactagaaaaaccacacgatgccgcacaatacatatgcatgttatacaaagatgactaccttgagttcacagaaagtggagcaacacatttgtgtagaatagcaggcctaccagcttcacaaaataataaaattgatattcgtccaatatacgccgtatctgactgtaaagattggataatagccacaaatgaaaacatgttagaaccatgttggaaaccacaaaaagaagaaaaacgaataagtgttaatgtattattcggaaagcataaagctagatccgtaacggtgaaccccatcggacgggtcttccgaaaatga

SEQ ID NO: 5130 - RNA, 3387 nt, synthetic construct
  misc_feature 1..3387: note = Cas9 variant
  source 1..3387: mol_type = other RNA
atgtcagatttagttctgggactggacataggaataggatcagtaggagtcggtatactcaacaaagtaacaggagaaataatacacaaaaactcacgaatatttccggcagctcaagcagaaaataacgtagaaaggagaacaaatagacaaggtagaagactaaccagacgaaagaaacacagaagagtaagacttaaccatctctttgaagaatccggactaataacggacttcaccaaagtatcaataaaccttaacccataccaattacgagtcaaaggactaatagacgaattgagtaacgaagaattattcatagctttaaagaacatggtgaaacatagggggataagttacttagacgacgcatcagacgatggtaattcctcagtaggagactatgcacagatcgttaaagaaaattccaaacaactagaaacaaaaacaccaggacaaatccaactagaaaggtatcaaaaatatggtcaattaagaggagactttaccgtagaagaagacggaaagaaacacagacttataaatgtgttccctaccagtgcatacagatctgaagcattaaggatactgcaaacacagaaagaatttaatcctcaaatcacagacgagttcataaatcgatacctagaaattttaaccggaaaacgcaaatactaccacggaccaggaaacgaaaaatccagaaccgattatggacgatatacaacaaagaaagattcagaaaatgaatatataactctcgataacatattcggtatactaatcggcaaatgcacattttaccctgaagaatatagagcagcaaaagcctcttatacagcacaagagttcaacttgctaaacgatttaaacaacctcacagtcccaacagaaaccaagaaactaagcgaagaacagaaaaatcaaataataaattatgttaaaaatgaaaaagcaatgggccccgcaaaattattcaaatacatagcaaaattacttagttgcgacgtagcagacataaaaggttatagaatagacaaatccgacaaagccgaaatccacaccttcgaagcatacagaaaaatgaaaactctagaaaccatagacttcgaaaagatgagtcgcgatcaattagataaattagcatacgtactaactctaaatacagaaagagaaggaatccaagaagccttagaccacgaatttgcagatggaaacttctcacaagaacaaatagacgagctagtccaattccggaaagccaattcttccatattcggcaaaggatggcataacttctctgtaaaattgatgatggaacttattccagaactatacgcaacatcagaggaacaaatgacaatactcacaagattaggaaaacaaaagacaacttcttcatcaaacaaaaccaaatacattgatgaaaaacttttaacagaagaaatttacaaccccgtagtggcaaaatctgtaagacaagctataaaaatagtaaatgcagcaataaaagaatatggtgactttgacaacatagtcatagagatggccagagaaactaacgaagatgacgaaaagaaagccatacagaaaatacaaaaagccaacaaagatgagaaagacgcagccatgctaaaagcagcgaaccaatacaatggacgagctgaactaccacattcagtatttcacggacataaacaattagctacaaaaataaggttatggcatcaacaaggagaacgatgcttatataccggtaaaactattagtattcatgacctaataaataacccgaaccaattcgaaatagaccatatattacctttaagcataacatttgacgattcactcgctaacaaagtccttgtatacgcaacagcaaatcaagaaaaaggtcaaagaacaccataccaagcattggactccatggatgatgcttggtcctttcgcgagttaaaggctttcgtaagagaaagcaaaagcctcagcaataaaaagaaagaatatctattaacagaagaggacatctcaagattcgacgtacgaaagaaattcatagagaggaacctagtagacacaagatacgcgtcacgagttgtattaaatgcactacaagaacatttccgcgcacacaaaacggacacaaaagtctccgttgtcagaggacaattcacaagccaactgcgaagacactggggaatagagaaaaccagagatacttatcaccatcatgcagtcgacgccttaatcatagcagctagctcacaattaaacctttggaagaaacagaaaaatactctagtaaactatagtgaaaatcaactactagatatcgaaacaggagaattaatatcagatgatgaatacaaagaatcagtattcaaagcaccatatcaacattttgtagatacactaaaatccaaagagttcgaagatagcatactattctcatatcaagtagactcaaaatttaaccgaaaaataagtgatgctacaatctacgcaaccagacaagcaaaagtaggaaaagacaagaaagacgaaacatatgtattaggaaaaatcaaagacatatactcacaaacaggatacgatgcatttatcaaaatctaccaaaaagataaatcaaaatttttaatgtaccgccacgacccacaaacttttgaaaaagttatagaaccaatactagaaaattatccaaataaagaaatgaacgaaaaaggcaaagaagtcccctgcaacccattcttaaaatataaggaagaacacggagactatattcgaaaatacagcaagaaaggaaacggacccgaaatcaaatccctaaaatactatgatagtaaattaggaaaccatattgacattactcccaaagactcaaacaataaggtcgtgcttcaatcagtgagcccatggagagcagacgtatacttcaacaagacaacaggtaaatacgaaatattaggattaaaatacgcagatcttcaattcgaaaaaggaacaggaacatataagataagccaagaaaaatacaatgtaattaagaagaaagaaggagtcgactcagactctgaatttaaatttacactctataaaaacgatctcttattaataaaagacaccgaaacaaaagaacaacaattatttagattcctatcaagaaccaaacccaacgttaaacactatgtagaattaaaaccttacgacaagcaaaaattcgaaggcaacgaaagcctcataaatgtgttaggagcagtagccaaaggcggccaatgtcaaaaaggtataaacaaaccaaacattagcatatacaaggtaaggactgacgtcctaggaaaccaacatataatcaaaaacgaaggagataaacctaaactggatttctga

SEQ ID NO: 5131 - RNA, 3387 nt, synthetic construct
  misc_feature 1..3387: note = Cas9 variant
  source 1..3387: mol_type = other RNA
atggatgagaaaatggactataggatcggactagatatcggaattgctagcgtgggatgggccgtcctacaaaataattcagatgatgaacctgtcagaatagtggatctaggagttaggatattcgatacagcggaaataccaaaaactggtgaatcacttgccggaccccgaagggctgcaaggaccacacgaaggagactaagaagaagaaaacatagacttgaccggatcaaatggttattcgaaaaccaaggactaatcaacattgatgacttcctaaaaagatacaatatggcaggccttccagatgtatatcaactaaggtacgaagccttagatcgaaaattaacagacgaagaactagcacaagttttactacatatcgcaaaacaccgaggatttaggagcacacgcaaagcagaaacagcagctaaagaaaatggagcggtgttgaaagcaaccgatgaaaaccagaaaagaatgcaagaaaaaggatataggacagtaggtgaaatgatttacttagacgaagcctttaggacaggatgctcatggtcggaaaaaggttatattctaaccccaagaaataaagccgaaaattaccaacacaccatgctaagggctatgctagtcgaagaagtaaaagagatattcagctcacaaaggagactaggtaatgaaaaagcgacagaagaattagaggagaaatatcttgaaataatgacatcacaaaggagttttgatttgggtccagggatgcagccagacgggaaaccgagcccatacgcgatggaagggtttagtgacagggttggaaaatgcacatttctaggagaccaaggggaattaagaggagcaaaaggaacttacacagctgagtactttgtagcattacagaaaataaaccatacaaaacttgtcaaccaagatggagaaacaagaaatttcacagaagaagaaagaagggcgttaacattactgttattcacacaaaaagaagtgaaatacgccgctgtgagaaagaaattggggctacctgaagatatattattttacaacctaaattacaagaaagccgccacgaaagaagaacaacagaaagaaaatcaaaacactgaaaaagctaaattcataggaatgccatattatcacgattacaagaaatgcttagaagaaagagtaaaatatctaaccgagaatgaagtaagagatctctttgatgaaataggaacaatcctcacatgttataaaaacgatgattcgagaactgaaagattagcaaaacttggtctagttccaattgagatggaaggattactagcatacacaccaacaaaattccaacatttgtccatgaaagctatgagaaatataatacctttcttggaaaaaggaatgacatatgacaaagcatgcgaagaggcaggctacgattttaaagcagattccaaaggaataaaacagaaactcttaaccggggaaaaagtgaaccaaacgataaatgaaataacaaacccagttgtcaaaagatcagtatcccaaaccgtcaaagttataaatgctataataagaacgtacggaagcccgcaagcaattaatatagagctagcaagagaaatgtcaaaaacttttgaagaaaggcgaaaaataaaaggcgacatggaaaaacggcagaaaaacaatgaagatgtaaagaaacaaatacaggaattaggaaaattatcacctactggtcaagatatactcaaatacagactctggcaagaacaacagggaatttgtatgtattcaggtaaaactataccactagaggaactatttaaacctggttacgacatagaccacatcttaccatattcaataactttcgacgatagttttagaaacaaagtacttgtgacaagtcaagaaaacaggcaaaaaggaaatagaacaccatatgaatatatgggaaacgatgagcaacgatggaacgaatttgaaacaagggtaaaaacaacaataagagattataagaaacaacaaaaactacttaagaaacatttttcagaagaagaacgctccgagttcaaagaaagaaacctgactgatactaaatacatcacaaccgtaatatataacatgataaggcagaacttagaaatggcaccattaaacagacctgagaaaaagaaacaagtcagagcagtcaatggcgcaatcaccgcttacctacgaaaaaggtggggcctcccacagaaaaacagagaaacagacacacaccatgctatggatgcggtagttatagcatgttgtacagatggtatgatacagaaaataagcagatatacaaaagttagagaaagatgttatagcaaaggtacagaatttgtagatgcggaaacaggcgaaatatttcgccccgaagattacagcagagcagaatgggatgaaattttcggcgtacatataccaaaaccttgggaaacatttagggcagagttagatgtaaggatgggtgacgatccaaaaggatttctagacacacacagcgatgttgcactagagctagactatccagaatatatatatgaaaacttacgaccaatattcgtgtcaagaatgccaaaccacaaagtaactggtgcagcacatgcagatactatacgtagcccacgtcattttaaagacgaaggtatagtactgacaaaaacagcgttaacagatttgaaactggataaagatggggaaatagacggttactataacccgcaatcagacttacttctttatgaggcattaaagaaacaattgctattatatgggaatgacgcaaagaaagcatttgcacaagattttcacaaaccgaaagcagatggaacagaaggcccagtagtacgtaaagttaaaatacagaagaaacaaaccatgggagtgtttgttgacagcggaaatggcatcgctgaaaacggaggaatggtgagaatagatgtcttccatgtgaacggtaaatactactttgtgccagtatacacagcagacgtcgtaaagaaagtacttcctaatagagccgctacagcacataaaccatatggagaatggaaagtaatggaagacaaagattttctttttagtctatacagccgagacttaatacatataaaaagcaagaaagacatcccgataaaaatggtcaacggtggtatggagggtatcaaagaaacttacgcgtattatattggcgccgatatatcagctgcaaatattcaagggatagcacatgactctagatataaattcagaggccttgggattcaaagcctagatgttttagaaaaatgtcaaattgacgtacttggacacgtttccgtagtaaggagtgagaaaagaatgggattttcatga

SEQ ID NO: 5132 - RNA, 3387 nt, synthetic construct
  misc_feature 1..3387: note = Cas9 variant
  source 1..3387: mol_type = other RNA
atgtcagacctagtccttggtctcgatataggaataggaagcgttggtgtaggtatcttgaacaaagtcactggagaaatcgttcataaaaacgcaagaatattcccggccgcacaagcagaaaataatgtagaaagaaggaccaatcgacaaggaagacgtttaacgcgaagaaagaaacatagaagagtacgtttaaatcatatcttcgaggaaagtggattaattacagactttacaaaagtttcaataaacctaaatccataccaattacgagtcaaaggcctaacagacgaactatctaatgaagaattattcatagctctgaaaaatatggtaaaacatcgaggaatatcttatcttgatgatgcatcagatgatggaaatagcagcgtaggagattatgcccaaattgttaaagaaaatagtaaacagttagaaaccaaaacaccaggccaaatacaactagaacgataccagaaatatggtcaactacgaggggattttaccatcgaagaagacggaaagaaacatagattaataaatgtattcccaacgtcagcatatcgggcagaagcattaaggatactacaaacacagcaagagttcaatcctcaaataacagacgagttcataaacagttacttgcagatcctaaccggcaaaagaaaatattaccatggccctggcaatgaaaaatccagaactgattacggacgatacaccaccaagaaagacagcgaagacgaatatatcactctggacaacattttcggcatactcataggcaaatgtacattttatccagaagaataccgagcagctaaagcaagttatacggcacaagagttcaatctcctaaacgatttaaacaacctcaccgtaccaacagaaacgaagaaactatccgaagaacagaaaaatcaaatcataacatatgttaaaaacgaaaaagcaatgggcccagcaaaactcttcaaatatattgcaaaactcttagcctgcgacgtagcagacatcaaaggataccgtatagataaatcagacaaaccagaaatacacacatttgaagcctacagaaaaatgaaaaccctcgaaaccatagatgtcgaacaaatggaacgagaaaaactagacaaactagcatacgttttaacactaaacactgaacgagaaggtattcaagaagccatagaacacgagttctcggacggaacattttcacaagaacaagtcgacgaattagtgcaatttcgaaaatcaaatagctccatttttggaaaaggatggcataacttttcagtaaaattaatgatggaattaataccagaactatatgctacatcggaagaacaaatgacaattctaacaagacttggaaaacaaaaacgaaccagttcatcaaacaaaactaaatacattgatgagaaaaggttaacagaagaaatatacaatccagtagttgcaaaatctgtaagacaagcaataaaaatcgttaatgcagcaattaaagaatatggagacttcgataacatagtaatcgaaatggcacgcgaaatgaacgaagacgatgaaaagaaagccatcaagaaaatacaagaagccaataaatcagaaaaagacgcagctatgaggaaagcagcaaaccaatataatggaaaagcagaactaccacattccgtattccatggccacaaacaattagcaacgaaaatcagattatggcaccaacaaggagaacgatgcctttacacgggaaaaacgatcagtatacacgacctaataaacaatccaaatcaatttgaaatagaccacatcctacccttatcaattacatttgatgatagtcttgccaataaagtattagtatatgcaacagcaaatcaagaaaaaggacaaagaaccccttatcaagcattagactccatggacgacgcatggtcattcagagaactaaaagcattcgtaagggaatcaaaaaccttaagtaacaaaaagaaagaatacctcttgacggaagaagacatatcaaaattcgacgtccgaaagaaattcatagaaagaaacctagttgatacccgatacgcctcacgagtagtacttaatgcactacaagaacactttagagcaagaaaaattgacacaaaagttagcgtggtcagaggacaattcacaagtcaattaagaagacattggggcatcgacaaaactcgcgatacataccatcaccacgccgtcgacgcgctaataatcgccgcatcttcacagctaaacttatggaagaaacagaaaaacaccttagtttcttacagtgaagatcaattgttagatattgaaactggagaacttattagcgatgacgaatacaaagaatcagtttttaaagctccttatcaacatttcgtagacacattaaaaagtaaagaatttgaggacagtatcctattcagctaccaagtcgatagcaaatttaataggaaaataagtgacgctacgatatacgctactagacaagcaaaagtaggaaaagacaagaaagacgagacgtatgtgttgggtaaaatcaaagatatttactcacaagcgggatacgatgcatttattaaaatataccaaaaagataaatccaaatttctaatgtaccgacatgatccccaaacattcgaaaaagtaatagaacctatattagaaaattacccaaacaaagaaatgaatgaaaaagggaaagaagtcccatgtaatcccttccttaaatacaaagaagaacacggggactatatccgaaaatatagcaagaaaggaaacggaccagaaatcaaatccctaaaatactatgatagtaaattgggaaaccacatagacatcacacccaaaaatagtaataataaagtagtcttgcaaagtgtatctccatggagagcagacgtctactttaacaaaacaactggtaaatacgaaatcttaggactcaaatacgcagacctccaatttgaaaaaggaacgggaacatataaaataagtcaagaaaaatataacgatatcaaaaagaaagaaggagtagacagcgattcagagttcaaatttaccctgtacaaaaacgaccttttattaataaaagacacagaaacgaaagaacaacaactattcagatttctctctcgctcaatgcccaataagaaacattatgtagaactaaaaccatactccaaagacaaattcgagaaaaacgaaacactcatagaaatcctgggacccacagacaaaagtgggaggtgcatcaaaggacttgccaaatccaacttatcaatcttcaaagtaagaacggatatcttaggcaaccaacatatcattaaaaacgaaggtgacaaaccaaaacttgacttttga

SEQ ID NO: 5133 - RNA, 3387 nt, synthetic construct
  misc_feature 1..3387: note = Cas9 variant
  source 1..3387: mol_type = other RNA
atgacaaaaatcctcggtctagatttaggtacaaactccatcgggtgggccgtcgttgacgaaaaaaaagaaaaaatattagggatgggctcaagaatattcccggaaggagttgtaaacataggagaaggagaaggccgtgaaactagcaaaaacgcaagtagaacagacgcgagaggcacacgcagacaattctttaggcgaaggcttcgtaaacgatacttattacgtgaactagcaaaaaaaggactatgtccaatcaactacactctagttaaagagtggaacgaagctcaaatattcaaaaacaaacaattacaagaatggtttaaacttaatccatacgaattacgttcaaaagcaatacaagaaaaaatatcattggaagaattaggaaggatcttctatcatttcatacaaagaagaggtttccagtctaacagccgaagcgcaggcgtagacaacatagaaaaatcagtcatctttaaaggtgacacgaaaacgggcaaaataggaatatccgaaacattagaaagtataaaaaacacaaaaacactaggatcctacttacacactatatatccaaaacaaaacaaaccatatagtggccacaaagaacgcataagaaacaggtacacaacacgccaaatgtacatctacgaatttgaaactatatgggaatatcaaaaacagttctacagtgaactatcaaacgaactaaaaacagtactaggtggtcgcaaaaaagacggatacaaagaggatggaatactcttccatcaaaggcccctaagatcacaaaaacatctggtaggatactgcagttttgagccaaaaaaaacaaaatgtcaaataaatacaataccattcgaactatttcgcatatatcaatgggtgaatacagtcgattgcaacgaaaaagtaacctcagaagatcgaggaaaaatggtagaacttctattaagcaaggaaaaagtatcattcaaagaaataagaaaagtaataaataaatcagatggatactatcaatttaattacaaaaatgacgacaaaatagtagggtcatacacaatttcaaatctaagtaataaaaagttttttggaaaaaagtggtttgatttcagcgacaaagaacaagaagatatatggcacgtactttctttcttcgacgatagagataaactcaaacaatacgcaattaaatattggggttttaatgaagaaaaagctgtaaaaataagcaaatttaacttaaaagagggatactcaaacttatcacgcaaggcaatccataacatcctcccattcctaaaactaggattcatgtatgacgtcgcagtcggactcggaggcgtaaagaatgccctcgccgacaaatggatagaaaacgaacagtttattttagacaacgtacctagtgtagtccgtagcaatttcaagggtggctacatagaaccattaaaacaaatgctgaaatacgaatttgacgtctcagataaacaactactaaaactataccaccacagcagtgcaattgaaaccacggaattgttaaaaaaattacctatcaactccgaagccgacaaagaaattcaaagcatcaaaaatccagtagtaataaccgcattattcgaaataagaaaattggttaatgagataatagatacgtacggaaaatttgatgaaatcaaagtcgaactcgcaagagatttaaaagcttcaaaaagcaaacgctacgacacaagaagggaacaattaagactagaaaaagaaaatgaccggattaaaatagaactcgaaaacttaggacaaagaataaatcacataacaatcctaaaatacaaactatgggaagaatgcgacaaaagatgtccatttacaggaaaaaatatcgaagttaacgaactgttcagcggagaagtacaaatagaacacatattcccctggtcgagatctttaaatgatagttttatgaataaaacactctgtttcgccgatgaaaaccgagcaaaggggaataaaaccccctatgaattttatagtgaacaaggagaacaaaaatgggaagaaataaaaattcaagccctaagttgcttcaaaaataaaccgaactatcccaacgcctatcaaaaatttaaacagttcgtaaaaaaaaaacatgatgaagactttataagcagacaactcaacgacactcgatatataagcaaagaagcaaaaaattatctctcgaaaatatgcaacaacgtacaagtagcacccggacaaatgacagcaactctaagacataaatggggactaaacacaattttaaacaaagatgatgacactaaaacaagagacgaccatagacaccacgcaattgacgcacttgttatggcgtgcagtacaagatctcatctacaggaactcagtaaacgtaataggtatcaaaaagactacgaattcaaagatttccccatgccttggcaattctttagacaagacgcagagaaatcagtagaacaaatattggtatcgcataaaaaacttaatacaatcttaacggtacgaacacacaaaacgaaaaaaaacggagtagtctacaaaaatataggagtagccgcccgaggtcaactacataaagaaacggtattcggaaaaagaacagctccagatggtatagaagcatatcacgtacgcaaaccaatagaatcgctatccacacacaaacatataaacaaagttgtcgacgaaacaattagattactaattcttaaacaagttaacaaactgggcggattcgtaaaaggtaaaatccctgagggaaccttttataacacagatgaaaacggaaacaaacaaccacaaatcttcctacctaacaaaaatggaaatcccgtaccaataaaaaaaatacgtttacgagaaaacataggaggagcagaacaactaaaaagcacagtcaaccaacacgtaaatcctagaagtaaccaccacgtactaatctacaaagattttgacgataaccttaaagaaaaggtggtcacattctggacagcggtcgaacgaaagaaacaaaaacaagcagtattccaattacctgaaaatgggaaagaaattgttactactttacaaataaatgacatgtttttattaggcttgaaagacgatgaaataaactgggaacacccaaaattcaccttactcaaagaacatttatatcgagtacaaaaattcacgtcaggcgactactacttccgcaaacacatagagagcaatctaaatggagagctaggtaaagcttaccaatacatcaaaggattcggtgaaggaaaaaccggatggaaaacatttaatccaatcaaaataaaagtttcagtttcaggaaaaatagaaaaagtatga

SEQ ID NO: 5134 - RNA, 3390 nt, synthetic construct
  misc_feature 1..3390: note = Cas9 variant
  source 1..3390: mol_type = other RNA
atgaatggactggtattaggactagatatcggaatagcatccgtcggtgcaggaatactaaagaaagacacaggcgaaatcattcacgcaaatagtagattattcccagccgcaaccgcagataataacgtcttaaggagatcatcaaggcaagctcgacgtagcactcgacgaaaaagacatagagctgtcagactacacgatctatttgaagattacgggttactgaccgatttcagcaaagtgtcaataaatctgaatccatacaaactacgagtagagggaatggacatccaattaactaccgaagaattatttatagcacttaaaaatattataaaaagaagaggaataagttatctcgacgatgccagtgaggacggggtaacagtttcatcagactacggaaaagcagtagaagaaaacagaaaattattaagcgaacagacaccaggtcaaatacaacttgaaagattcgagaaatatggacaagtaagaggcgacttcacagtagaagaaaacggcgaaaagagacgactaattaacgtatttagtacatcaacatatagaaaagaagcagaacgaatattacgaaaacaacaagagttcaacaataaaataacagacgattttatagacgactacttaacaatcttaaccggaaaacgaaaatattatcacggcccaggaaacaagaaatctagaacagattacgggagatatacaacaaagaaagatagcgaaggtaaatacataaccctcgacaacatcttcggagtactaattggaaaatgcacattttatccagatgaatatagggcttcaaaagcctcatacacagctcaggagttcaacctcctaaatgacctgaataacctaacagtaccaactgaaacaaagaaactctcagaaaaacagaagaaaacaatagtcgaatacgcaaaaacggcaaaaacactaggggcatccacactactaaaatacatagcaaaaatggtagacgcaagcgtagaccaaatccatggatatcgagtcgacgtaaacaagaaaccggaaatgcacacctttgacgtatacaggaaaatgcaaagcctagaaaccttcaacgtaaatgaaatgccaagagaagtactagacgaactagcacatatattaactctgaacacagaaagagaaggcattgaagaagcaatcaacacaaaattaaaagggacctttaaccaagatcaagtattagaattagtccaattccgcaaaaacaatagtagcttatttagcaaaggatggcacaacttctcattaaaactaatgatggaactaattccagaattatacgcgacttctgaagaacaaatgacaatattaacaagactaggtaaacaaaaatccaaagagattagcaaaagaactaaatacattgatgaaaaagaaattacagaagaaatttataatccagtagtcgcgaaaagcgtacgacaagctataaaaatcattaacgaagcaacaaaacaatatggcatatttgatcatatagttattgaaatggcaagactaacaaatgaagaggacgcaaagaaagactatattaaaagacaaaaagcaaatcttgatgagaaaaatgccgcaatggaaaaagcagcttttcagtacaacggtaagaaagaactgccagattccatattccatggacataaagaactcgctacgaaaatcagactatggcaccagcaaggcgaaaaatgcctatacacgggcaaaaacatacccataagtgacttaatacaaaaccaatataaatacgaaattgaccacatactaccattatcactcagctttgacgactctttaagtaacaaagtattagtcctagccactgccaaccaagaaaaaggacagagaacaccttttcaagcactcgatagaatggacgacgcttggagctatagagaatttaaaagctacgtcaaagattcaaaattactaggcaataaaaagaaagactatctccttacagaagaagacatatcaaaaatcgaagttaaacaaaaatttatcgaaagaaatttagttgacactagatattcatcaagagtagtattaaacgcattacaagatttctacaaaaatcatcatttcgatacaaccatctccgtagttcgaggacaatttacaagtcagctacgacgaaaatggggactagaaaaatcaagagaaacttaccaccaccacgccgtagatgcattaattatagctgcatcatcacaattacgactttggaagaaacaaaacaatccactaatattctacaaagaaggacaattcgtcgattcagaaacaggggagatactctcactaaatgatgatgaatataaagaattggtattcaaagctccatacgaccattttgtagataccctaagatcgaaaacattcgaggattcaatcctattttcataccaggttgacagtaaatacaatagaaaaatatccgacgcaacaatatacgctaccaggaaagcaaaattagataaagacaaaagcaaagaaacatacgtactttcaaaaataaaagatatctactcacaagctggttacgacgcattcataaaaatatataataaagacaaatcaaaatttctaatgtatcacaaagattcacaaacatttgaaaaagtaatcgaagaaattctacggacttaccccagtaaagagttcaacgataaaaacaaagaagtaccatgtaatcccttcgaaaaatatagacaagaaaacggccctataagaaaatactcaaagaaaggaaatggacccgaaatcaaaagcctaaaatattatgacaaaaatattccagaatcattcataaatatcacaccaagtaattctaaaaataaagtgatattgaggcaattaaacccgtggagaacagacgtctacttcaaccatcaaaccgaaaaatacgaattgctaggactcaagtacgccgatcttcaatttgaaaagaaaacagggacatattcgataactatagacaaatacaacgaaataaaggaaaaagaaggggtaggagaacaaagtgaatttaagtttactttatataaaaatgatcttctacttattaaagacacaaagaacaacgaaaaacaaatctttcgatttctaagtcgaaccatgcctaacgtaaaacattacgtagaacttaaaccctacaacaaagccaaatttgacggaaatcaaccacttatcactatatttggaaatgttgctaaaggtggacaatgtctaaaaggactaaacaagcccaacattagtatatataaaattaaaactgatgtattaggtaataaatatttcatcaagaaagaaggggacaaaccaaaactcaaattctga

SEQ ID NO: 5135 - RNA, 3390 nt, synthetic construct
  misc_feature 1..3390: note = Cas9 variant
  source 1..3390: mol_type = other RNA
atggcggacaggatatcactaggattagacataggggtagctagtgtgggattttcagtactggacatagataaaggcaaagttatcgagttagggagcagattatttaacgccactgttgcagaaggaaatcaagatagaagaagcatgagaggagcaagaagactactcaacagaaacaaacagagaagacaagatacaggaaaattattccaaaaatttggcttattagacaatttcaacaaagacaatttctacgataccttcaatcaaaattggaatccttatgaattaagagtcaaaggcctaacagaacatttaacaaaaaaggaactggctgaaagcttataccagatcgtaaaacaccgcgggataagttatgccctgaaagatgcagacgctgatgaaggaggaacagattacagtgcatcactcaaaataaacagtcaagaactagcagaaaaaacaccagctcaaatccaattacaaaggttaaatgattatggaaaagtaaggggacaggtagtcataggcgatgatccagataatcaaaaagtactattaaacgtattcccaacatcagcatatgaaaaagaagcaaaacagataatagcaacacaaaaacagttctatccagaaatactaaccgatgaattcacgaaagaatactgtaaaatattaactagaaaacgtgattacttcgtagggccaggcaacgaaaaatcacgcaccgattatggaatatacaaaacagatggacgaacattagataacttgttcgaagaacttataggccatgacaaaatttatcccgacgaattaagagcatcagcagcgtcatataccgctcaattatttaacgtgctaaatgacctgaacaatctacggatattaagttatgaagatggaaaactaactaaagaggacaaagaaaaaataatagcagaaataaaatcaaacaccactacaattaacatgctaaacgtgataaaaaaagtcgctggttgtagcaaagaagacataaaaggattcagagtaaatgaaaaagataaaccagaaattagctcgatggccgtgtatagaaaagtccacaaagatctgctcaaagtaggagtagacatatccgattggccagttgaattcattgacaaactaagttttattttaacactaaacactgaaaacggcgaaataagaaagcagttaaataatcgtctagtaccagaatttgattttctaaatgacgacttaatccaactaattattgataacaaagacagcttcgaaataaaaactaacaataaatggcatagattctccctaaaaaccatgaacaagttaatgccagaaatgctggaacgcccagtcgaacaaatgacactattaaatgaaatgggacttgtaaaaaaagacaaaaaaagattcgaaaacaataaatatctaccatataaagagatagcaaaagatatattcaacccagtcgcttcaaagtcagtaagagaagcactaaaaatagttaacgcagtactaaaaaaatatgggcatatcgactatctagtaatagaaatgccaagagataaaaatctaaaagaagaacaagacaacataaaagaattccaaaacaaaaataaaaaagccaaggatgcagcctttgaagcatttgtcaaaagcgtaggctcagaacaacgcgtgaaagaggctttatcaaaaaacagaaaattgcaaatgaaaatgcgactgtggtaccaacaacaggagattgatccttacaacggagaaacaattgacgccacagacctaataaacaatccagacaagtttgaaatagaccacataatcccacaaagtatcagctttgacgatagcattaataataaaacactatgttttgcatcaatgaaccaagtaaaaggccaaaaaactccgtacgagttcatgcttgaaggacatggtcaaggatatgacaaattcaaagccactgtactagataataaaaatttcgacaggaataaacgaaaaaattatctttttgaagaaaacgtcagtgacatagaaacgagaaaaagatttcttagcagaaacctagtggatacgagatacagttctcgtgtagtcttaaacagtctccaagacttcttccacgaaaaaagcgcagacacaaaagtaacagtaataagaggtaaattcacctctaatatgcgcaaacactggcatatagacaaaacaagggaaacatttcaccatcatgcgatagacgccagcatcatagcagccacacccttccttagaatgtggaagaaaggtggaactatatttccggttaaggtaggagaagaaagcatagacatagaaacaggagaaatactagatgataaaaaatttgataaagttatgtatgaagaaccatacaacggatttgtatcagaaatcatgaatgccgacgaccggataaaatttagtcaccaagtagacaaaaaaatgaaccgaaaagtcagtgatgctactatatatagcacccgaacaggaaaactggcaaaagataaaaaagacgcagaatacatagtagcaaaggttaaagatatatatagcgtagacgggtttaaaaaattcaaaaaagtctatgacaaagataaaagtaaatttctcctatacaaatatgacccgagaacattctccgaactagaaaggattatatcagattgccctgataaagtagagaaagtacaaacaaatggaaaagtgaaagccgtagacgtaagtccattcgaaatgtatagaaggtaccacggcatgataaaaaaatatagtaaaaaaggaaatggacctgccattaaacaactaaaatacttagacaagaaattaggttcgcatatagacataacacccgccaatgcaaatggcaaacacgtaatattgcaatcactaaaaccctggcgtactgatgtatacttaaatcatgaaaccggagaatacgaaataatgggaattaaatactccgatttaaagttcaacaaaaatgttggatatggtataaagaaagataaatatctagaaataaaaaaaaacgaagaagtaagtgaaaaaagcgaattcatgttctcactttaccgaaaagatcgcgttcgaatccaaaacatgaaaaccggagaaagtgtagaattactgttctggtcaagaaacttttcgaacaaaaaatatgccgaactaaagccaatatttaaatttgtcacagaagacgacgattggccagtttacggacatgcgaaaactcaaatattaaaacgactggtacccaaagactgtaaaatatggaaggtaaacaccacaatactaggagacccctactatttagaaaaagaatccgacaacccaaaagatatattagactga

SEQ ID NO: 5136 - RNA, 3390 nt, synthetic construct
  misc_feature 1..3390: note = Cas9 variant
  source 1..3390: mol_type = other RNA
atgacaaacggcaaaatccttggtctcgatatcggaatcgctagcgtgggagtgggtatcatcgaggcaaaaactggaaaagttgtacatgcaaatagccgcctattcagcgcagcaaacgccgaaaacaacgccgaaagaagaggattccgaggttcaaggagactcaatagacgcaagaaacacagagtaaaaagagtcagagatctattcgaaaaatatggaatagtaacagatttccgtaacctaaatctaaatccttatgaattacgagttaaaggattaacggaacaactaacaaacgaagaattgttcgcagctttgcgaactataagtaaaaggcgaggaataagttatctagatgatgcagaagacgacagcacaggatcgacagattatgccaaaagcatagatgaaaaccgacggttgttaaaaacgaaaacaccaggacaaatccaacttgaaagactagaaaaatatggacaactccgtggaaacttcaccgtatacgatgaaaacggtgaagcacatagattaataaacgtgttttcaacaagtgactacgaaaaagaggcgcgaaaaatattagaaactcaagcagactacaataagaaaatcactgcagaatttatagacgattatgttgaaatacttactcaaaaacgtaaatattatcatggaccgggcaacgaaaaatcaagaacagattacggacggtttagaacagatggtacaaccctcgagaatatatttggaatattaataggaaaatgtagtttctaccctgatgaataccgggcatcgaaagcaagttatactgcgcaagaatacaattttctaaatgatctaaataacttaaaagtaccaacggaaacaggaaaactcagcacagaacaaaaagaagcgttagtagaatttgcaaaatcaacagcaacccttggaccagcaaaactattaaaagaaatcgcaaaaattttagactgtaaagtagacgagataaaaggatatcgagaagacgataaaggaaaaccagatttacatacttttgaaccatatagaaaactaaaatttaacctagatagtgtaaacatagacgatctgtctcgagaagtactagacaaattggcagacatattaacactaaacacagaaagggaaggaatcgaagatgctatcaaaagaaatttaccaaaccaattcacagaagaacagatttcagaaataataaatgtaagaaaatcgcagtctacagccttcaacaaagggtggcacagcttttccgccaaactcatgaacgaactaattccggaattatatgccacctcagatgaacaaatgacaatattaactagattagagaaattcaaagtcaaaaagaaaagtagcaaaaatattaaaactatagacgaaaaagaaatcacagacgaaatatacaatcccgtagtcgcaaaatcagtccgacaaacgataaaaattataaacgctgcagtaaagaaatacggagactttgataaaatagtaatagaaatgccgcgtgataaaaatgcagacgacgagaagaaattcatcgacaaaagaaacaaagaaaacaagaaagaaaaagatgacgcattaaaaagggcggcatatctttataatggtacagacaaacttcctgacgaagtatttcacgaaaacaaacaactggagacaaaaatacgactttggtatcaacaaggagaaagatgtctatattccggaaaacccatacctattcaagagttagtacacaacagcaacaacttcgagattgaccacatcctaccattatcactctcattcgacgactcactagcaaacaaagtcttagtatatagctggacaaaccaagagaaaggacaaagaacaccttatcaggtaatagacagtatggacgccgcttggtccttcagagaaatgaaagattatgtactcaaacaaaaaggattaggcaaaaagaaacgagattatttattaacaactgaaaatatagataaaatagaggtgaaaaagaaatttattgaacgaaatcttgtagatacaagatacgccagtagagttgtactaaatagcttacaatccgctctcagagagctggggaaagatacaaaagtgagcgtagtaagaggtcaatttacatctcaattgaggaggaaatggaaaatagacaaatcaagagaaacatatcaccatcatgctgttgacgcattaatcatagccgcatctagtcagcttaaactatgggaaaaacaagacaatcccatgttcgtagactatggaaataaccaagtagtcgataaacaaactggagaaatccttagcgtgtcagatgatgaatataaagagctagtatttcaacctccatatcaaggctttgtaaacacaatctcgtcaaaaggattcgaagacgaaatactgttcagctaccaagtagatagcaaatacaatcgaaaagtatcagacgcaactatatacagtacacgaaaagctaaaataggaaaagacaagaaagaagaaacatacgtcttaggcaaaataaaagacatctatagtcaaaacggattcgacacttttgtaaagaaatacaataaagataaaacacagttcttaatgtaccaaaaagacccactcacgtgggaaaacgttattgaagtaattttaagagactatccaacgacaaagaaatctgaagatggcaaaaatgacgtaaaatgcaatccattcgaagaatacagacgagaaaacggattgatatgcaaatattctaagaaaggaaaaggcacaccaattaaatcattaaaatattatgataagaaattaggaaattgtatagacattacacctcaagaaagcaaaaaccgtgtggtattaagacaaataagcccatggagagcggacatatactttaacccagaaaccctaaaatatgaactcatgggtctaaaatactcagacctatcattcgaaaaaggcactggtaaataccatatatcgcaagagaaatatgacgcgataaaagaaaaagaaggcgtaggaaaagacagtgaatttaaatttacattataccgtaacgacttaatactcataaaagacacactgaacaactgtgaacgaatgctgcgttttggaagcaaaaacgacacaagtaaacattacgtggagctgaaaccattagaaaaaggaaccttcgatagtgaggaagaaattttaccagtactaggaaaagtggccaaatcagggcaattcataaaaggactaaacaaaccaaatatttctatatataaagttagaacagatgtattaggaaataaatactttgtcaagaaagaaggcgataaaccaaaattagattttaaaaataacaagaaatga

SEQ ID NO: 5137 - RNA, 3390 nt, synthetic construct
  misc_feature 1..3390: note = Cas9 variant
  source 1..3390: mol_type = other RNA
atgtcgaacggaaaaatattaggactcgacatcggtgtagccagtgtaggcgttggtataatagattcaaaaacaggaaatgtaatacacgcaaacagtaggctattttccgccgcaaacgctgaaaacaatgccgaaagaagaggattccgcggagctcgaagactaactagaagaaagaaacatagagtcaaacgcgtaagagacctatttgaaaaatatgatataagcactgattttagaaacctcaatctaaacccatacgaattaagagttaaaggattgacagaacaattaacgaatgaagaactattcgcagcgctaagaactatagccaaacggcgaggtatatcctatctagatgatgcagaagatgattcgacaggaagcagcgactatgcaaaatccatagatgaaaacaggcgcttattaaaaactaaaaccccgggacaaatccaattagaacgactagaaaaatatggtcaactaaggggcaactttacagtgtacgacgaaaacggtgaagcacaccgattaataaatgtcttctctacatctgactacaaaaacgaagctagaaagatcctggaaactcaatccaattataataaacaaataacagatgaattcatagaagattacatagaaatattaacacaaaagaggaaatattatcatggcccaggaaacgagaaaagtagaacagattacggacgctttagaacagatggaacaacgcttgaaaacattttcggcatattaataggaaagtgctctttctatccggaggaatatcgagcatcaaaagcatcatacacagcccaagaattcaatttcttaaacgacctaaataacttaaaagtaccaacggaaaccgggaaactatcaacagaacagaaagagtacttagtcgatttcgccaaaaaaagtaaagctctcggtgcttcaaaactattaaaagaaatagcaaagatagtggactgttcggtagacgacataaaaggataccgggttgacaataaagacaaacccgacttgcatacgtttgaaccatacagaaaattaaaattcaatttaagctcaatcgacatagacgaattatcaagagaaacacttgataaactagcggatatattaactttaaacacagaaagagaaggcattgaagacgccatcaaaagaaacttaccatctcaatttacagaggaacaaatatccgaaatagtacaaataaggaaaaaccaatcctcagctttcaacaaaggatggcacagtttttcagcaaagctcatgaatgaattaataccagagctatatgtaacttcggaagaacaaatgaccatcctaactcgactggaaaaatttaaggtcaataaaaaaagctctaaaaacacaaaaacaatagacgaaaaagaaataacagatgaaatatacaacccagtggtagcaaaatcagtcagacaaacaataaaaataataaatgcagccgttaaaaaatacggtgatttcgacaaaatagtgatagagatgccaagggataaaaacgccgaagacgaaaaaaaatttattgacaaaaaacaaaaagaaaataaaaaagaaaaagacgattcattaaaaagagcagcgtttttatacaacggtaccgacaatttaccagacggtgtattccacggcaacaaagaacttaaaaccaaaatacgattatggtaccaacagggcgaaaggtgtctttacagtgggaagttaataagtatccatgatctagttcataatagcaacaaattcgaaatcgaccacatattaccactaagtctaagtttcgacgacagtctagccaataaagtcttagtctatgcctggacaaatcaagaaaaaggacaaaaaacaccctaccaagtcatagactcaatggacactgcatggtcatttcgagaaatgaaagactacgtgttgaaacaaaaaggattaggcaaaaaaaagtgtgaatacctattaacaactgagaatatagacaaaatagaagttaaaaaaaaattcatagagagaaacctagttgatactagatacgcaagtcgagtggtactaaattcactgcaaaccgcactaaaagaactaggaaaagacacaaaagtaagcgtcgtaagaggtcaattcacgagtcagctacgaagaaaatggaacatagacaaatcacgagagacttaccaccatcacgcagtcgacgcattaatcatagccgcaagttcccaattaaaactatggcaaaaacaagaaaaccctatgtttgaatcatatggagaaaatcaggtcgtaaataaagaaacgggagaaatactgtcaatcagtgacgacaagtataaagaactggtattccaaccgccctaccaaggatttgtaaatactataagcagtaaaggttttgaagatgaaatattattctcataccaagtagatagcaagttcaatagaaaagtatcagacgccactatatacagtacaagaaaagccaaattgggaaaagataaaaaagatgaaacatacgttcttggcaaaataaaagatatatattcacaggatggtttcgatacattcataaaaagatataaaaaagataaaactcaattcctaatgtatcaaaaggacccactaacatgggaaaatgtaatagaagtaatactaagagattacccaagtgaaaaactgtctgaagacgggaaaaaaactgtaaaatgcaacccatttgaagaatatagaagggaaaacggactaatctgcaaatattcaaaaaaaggaaatggaacaccaataaaatcattaaaatattatgataaaaaactaggaaattgtatagacataacaccggaaaagagtaaaaaccgagtagtattaagacaaataagcccatggagagcagacatctatttcaaccttgaaactttaaaatacgaactaatgggcctaaaatactctgatttatcattcgaaaaaggaacaggaaaataccacatatcgcaagaaaaatacgatgcaattcgagaaaaagaagggataggcaaaaaatcagaatttaaatttacactatatagaaacgacttgatccttataaaggacacattaaacaattgcgaaaggatgctaagattcggatcaaaaaacgacacatcaaaacactacgtagaattaaaaccgttagaaaaagggacattcgattccgaagaggagattctacccgttctcggtaaagtcgctaaatcaggccaattcattaagggattaaataaaccaaatatttcaatctacaaagtaagaaccgatgtactaggaaacaaattcttcattaaaaaagaaggcgacaaaccgaagctggattttaaaaataacaataaatga

SEQ ID NO: 5138 - RNA, 3390 nt, synthetic construct
  misc_feature 1..3390: note = Cas9 variant
  source 1..3390: mol_type = other RNA
atgagtaacggaaaaatactaggcttggacataggagtagcatcagtaggggtaggcataatagatgcgaaaacgggcaacgtaatccatgctaacagtcgattattctcagcagccaacgccgaaaacaatgctgaaagaagagggttcaggggagcaagacgactaacaagaagaaaaaaacatagagtcaaacgagtaagagacttattcgaaaaatatgacattagcacggactttagaaacttaaatctcaacccatacgaactcagagttaaaggattaacagagcaattaacaaacgaagagcttttcgccgccctaagaacaatagcaaaaagaagaggaatatcctacctagacgacgcagaagatgactcgactggaagttcagattatgctaaaagtatagacgaaaatagaagactgttaaaaactaaaactcctggtcaaatccaactcgaacgacttgaaaaatatggacaactccgagggaacttcactgtatatgatgaaaacggcgaagctcaccgattaataaacgtattctccacatcagattacaaaaacgaagcaagaaagatcttagaaacccaaagtaattacaacaaacaaataaccgacgaattcatagaagattacatcgaaatactaacccaaaaacggaaatattaccatggaccaggtaacgaaaaaagtcgtacagactacggaaggttcaggaccgatggtaccacactagaaaacatatttggcatactaataggaaaatgctcattctacccagaggaatatcgcgccagcaaagccagctacaccgcacaagaattcaattttctgaacgacctaaacaacttgaaagtaccgaccgaaaccggaaaactaagcacagaacaaaaagagtaccttgtcgacttcgcaaaaaaatcaaaagcacttggcgccagcaaactcctaaaagaaattgccaaaatagtcgattgctctgtagatgacataaaaggctatagagtagataacaaagataaaccagatctacataccttcgaaccatatcgcaagctaaaatttaacctctcaagtatcgatatagatgaattatcacgagaaactctcgataaattagcagacattttaacactaaacacagaaagagaaggcatagaagatacaataaagcgaaacctacctagtcagttcacagaagaacaaatctccgaaatagtacaaatacgaaaaaatcaaagctcagctttcaacaaaggctggcactcattctcagcaaagctaatgaacgaactcatacccgaactatacgtaacaagcgaagagcaaatgaccatactaactagattagagaaatttaaagtcaataagaaaagcagtaaaaacaccaaaactatagatgagaaagaaataaccgatgaaatttataacccggtagtcgcgaaaagcgttaggcagacgattaaaatcataaacgccgcagtaaaaaaatatggtgacttcgataagattgtaatcgaaatgccaagagataaaaatgcagaagacgaaaaaaagttcatagacaaaaaagagaaagaaaataaaaaagaaaaagatgactcacttaaacgcgcagcattcctttataacggcaccgataacctaccggacggcgtatttcacggaaacaaggaattaaaaacaaagatacggctgtggtaccaacaaggagaaagatgcctgtactcagggaaactcattagtatacacgacctagtacataactccaacaaattcgaaatagatcatatactaccgctatccctaagtttcgacgattcactagcaaacaaagtacttgtatacgcatggacaaaccaagaaaagggacagaaaactccttatcaagtaatcgacagcatggatgcggcatggtcattccgagagatgaaagactacgtactaaaacaaaaaggcattggaaaaaaaaaaagggaatatttattaacaactgaaaacatagacaaaatagaagtgaaaaaaaaatttatagaaagaaacttagtagacactcgctatgcttcgcgtgtagttctaaactcattacagacagctctcaaagaacttggaaaagacacgaaagtgtcagttgtcaggggacaatttacatcacaactacgacgaaaatggaaaattgataaaagcagagaaacatatcaccaccatgcagtagacgcactgataatagcagcatcaggacaacttaaactctggcaaaaacatgaaaatctcatgttcgaaaattacggtgaaaatcaggtagtaaacaaagaaactggtgagatattaagcatatcagacgacgaatacaaagaactggtcttccagcctccctatcaaggcttcgtcaatacaatatcaagcaagacttttgaagacgaaatactattcagttaccaagtagacagtaaattcaatagaaaagtaagtgatgcaactatatatagcacgagaaaagctaagttaggaaaagataaaaaagaagaaacttacgtattaggaaaaataaaagacatatatacacaagacggattcgacaccttcataaaacgatacaaaaaggacaaaacacaatttctaatgtatcaaaaggaccccctaacatgggagaatgtaatagaagtgatcctacgcgactatccatccgaaaagttatcagaagacggaaagaaaacagtcaaatgtaatcccttcgaagaatatagaagagaaaacggtctaatctgcaaatactcaaaaaaaggaaatggcacaccaataaaaagcctaaaatattacgacaaaaaacttggtaattgtatagatataacaccagaaaaatccaaaaacagagttgtactcagacaaataagtccatggagggcagacatatacttcaatctagaaacattaaaatacgaacttatgggactaaagtacagcgacctctcattcgaaaaaggaacaggaaaataccacatttcacaagaaaaatacgatgcaataagagaaaaagaagggataggtaaaaaatcagaattcaaatttacattatacagaaacgacttaattttgataaaagacactcttaacaattgtgaacgcatgctacgatttggtagcaaaaatgacaccagtaaacattatgtagaactaaaacctctagaaaaaggaacattcgattcagaagaagagattcttccagttctaggaaaagtagcaaaatctggacaatttattaaaggtctaaataaaccgaacataagcatctacaaagtacgaacagacgtattgggtaacaaatttttcatcaaaaaagaaggagacaaaccaaaattagactttaaaaacaacaataaatga

SEQ ID NO: 5139 - RNA, 3393 nt, synthetic construct
  misc_feature 1..3393: note = Cas9 variant
  source 1..3393: mol_type = other RNA
atgaataaaattctaggactagacttggggacaaactcaataggatgggcccttatagaaaacaatataatactcggcatgggatcacgagtcttcccagaaggagttgttaacctgggcgaaggtgaaggaagagaaacctcgaaaaacgcatctagaaccgaagcacgaggggttcgacgacaaatattcagaagaagacttaggaaaagatacctattaaaagaacttgctaaacataacctatgtccaatatcaccaacattaattaaagactggaatggaacagacatatttaaaaacgaattaattatacaatggttccaattaaacccttacgaactgcgagctaaagcgattcaagaagaaataacattaatagaacttggcaggattttctatcacatgatacaaagacgaggatttctttcaaattccagatccgcgggtgcagacgtaaaagaaacgtcaactatattcaaaggcgacgctaaaataggaaaaataggtatatcagacacattaaaatcgatagaacaaaacaaaacactaggatcatttcttcactcaatacaacccaaagaaaacgaaccatttagtggagaattagaacgcatcagaaaccgctacaccacccgacaaatgtatatagacgagttcgaaacaatttgggagttccaaaaacaataccattcggaactgaactctaacctcaaaaccattctaggaggcagaaagaaagacaattacaaagaagatggagttctctttcatcaaagaccactaagatcacaaaaacacctagtaggtttttgcagtttcgaacccaagaaaacaaaatgcaaattatccgcaataccatttgaactattcaggatataccaatgggtaaacactctctcgtacgacgttaatggagtaagacagaaaattacacaagaagaacgtaagaaaataatagacttattactttcgaaagaaaaaccaagttttaaagaaataagaaaagcaataggtaaattggacggaagctaccaatttaactacaaagatgacgacaaaatagtgggatctcatacaatcagtaatctatccaataagaaattcttcggaaataaatggtttgacttttcagaaaaagaacaagaaaacatatggcacatcttaagtttctttgatgacagagaaaaactaaaagaatacgcgattaaaaactggtcctttgacgaagaaagagcagttaaaatcagtaaatttaacctgaaagacgggtattctaatttatccagaaaagcaatcctaaacatcctcccttttctacaaaaaggatttatgtacgatgttgcagtaggacttgcaggagtcaaaaatactttatcagtcaactgggaagaacatgaacaatttgtgcttgacaatgtccctgagatagtaagatccaatttaaaaggcggatacattgaaccattaaagaacatgcttaaaaatgagttcaattgtaacgacaaacaattagaaaaactataccatcatagctcagcaatagaaacggaaaatatacttgacagacttccagtaaacctacacgcagatcgtgaaattcagaaaatcaaaaaccctgtagtaataactgcactcttcgaaataagaaaattagtcaatgaagtaatagacacatatggaaaacccaacgaaatcaaagtcgaattagctagagatctaaaagcatctaaaagtaatagactagaagcacgtaaaagacaaaaagatctagaaaaacaaaacgatcgagtaaaattagaattagagaatttaaaccaacgatcaaaccatataaacatcctaaaatacaaattatgggaagaatgcaaccacacttgtccgtttacaggacaaataataactatttcccaactctttactggagaagtacaaatagaacacatctttccttggtcaagatctttaaacgacagtttcaacaataaaactctttgcttcgcagacgaaaatagagccaaaggaaacaaaacaccatacgaattatatagcgaacaaggagaccaaaaatgggaggccatcaaactccaagcattatcatgcttcaaaaccaaagctaattacccaaactgctataataaatttaaacatttcgtgaaaaagaaacacgatgaagatttcatatccagacaactgaatgatactcgatatatttcaaaagaagctaaaaattatcttagtaaaatatgttccaatgtgctagtagcaccaggccaaatgacggcaactctacgacatcattggggattaaatagcatacttaacttagaagacgacactaaaacacgtgacgaccacagacatcatgcaatcgacgccctagtaatggcatgctcaacccgatcacatctacaagaactatcaaaaagaaaccgatataataaaaactatgatttaaaagattttccggacccctggcaaaactttagacaggacgcggaaaacgcagttgcacaaatacttgtcagtcataagaaaagcaaatcactcctaacagttagaacccacaaaactataaagaaaggcgtagaacataaaaacataggagttgctgcacgggggcaactacacaaagaatcagtttatggactgcgaaaagcacccaacagcaataaagccttccatattcgaaaaccattagagtctttgaccacagaaaaacaacttgagaaaattgtggacgattcaataagactacttatattaaaaagaataaatataattggagggtttattaaagggaaaataccaaaagaaacattcttcgtagtagatgaaaatggaataaaacaacctcaaatatttctcccaaacagaaatggaaacccagtaccgattaagaaagtaagaataagggaaaacattggtggagcagaaaaactaaaagagaatacaaaccaatacgtaaatccacgatcaaaccaccacgtcatcgtttatgaagattcgaatggaggcctaaaagacgatgtagtaactttctggactgcagtagaaagaaaaagacaaggacaagatgtcttcaaactaccgaacgacggagagaaaatcgtgtcaactctacagattaatgatatgttcctactaggactaaacgacgacgacatcataacattaacaagtaaagaactaaagaaacatctatttaaagtccaaacactaagttcatcattctacgagttccgtttaagtacagattcaacacaaaacaaaaatacaaacagcacagtgttcagaaggatacagagcttcggaatgggtaaaacaggatggaaagcattcaatccaataaaagttaaattaaactcaattggcgaagttaaaataatatga

SEQ ID NO: 5140 - RNA, 3393 nt, synthetic construct
  misc_feature 1..3393: note = Cas9 variant
  source 1..3393: mol_type = other RNA
atgacgaatggcaaaatattaggactagacataggcatagccagtgttggtgtaggaataatagaagcaaaaactggaaaagtagtacatgcaaacagtcgattatttagcgcagccaacgcagaaaacaatgccgaaagacgaggatttcgcggttcacggcggcttaaccgacgaaagaaacacagagttaaaagagtgagagatttattcgaaaaatacggaatagtaaccgattttcgaaacctgaatctcaatccatacgaattaagagtaaaaggattaacagaacaactaacgaatgaagaactatttgcagctttacgcacaatatcaaaaagaagaggcatatcatatctcgacgatgcggaagatgactcaacaggaagtactgactacgctaaaagcatagacgagaacagacgattacttaaaaccaaaactccagggcaaattcaactagaaagactagaaaaatacggacaactgagaggaaactttactgtatacgatgaaaatggcgaagctcacagactaataaatgtatttagtacatcagattatgaaaaagaagcccgaaaaattctagaaacccaagccgactacaataagaaaatcacagcagagttcatcgacgactacgtagaaatactaacacaaaaacgcaaatactatcatggtcctggaaatgaaaaatcacgtaccgattacggtagattcagaacagatggaacaacgcttgagaacatcttcgggatattaatcggaaaatgctcattttatccagatgaatacagagcttcgaaagcatcctatacagcacaggaatataactttttaaacgacttaaacaacctaaaagtaccaaccgaaaccggtaaactctcaaccgagcaaaaagaagccctagtcgagttcgcaaaaagtacagctacattaggacctgctaaactattgaaagaaatagctaaaatcttagattgcaaagtggatgagataaaaggctatcgagaagatgacaaaggcaaaccagatttacatacattcgaaccctacagaaaactcaaatttaatctagattcagtaaatatagatgatttaagtagagaagtgctcgacaaactagccgacatactaaccctgaacaccgaaagagaaggcatagaagacgcgataaaaagaaatttaccaaaccagtttacagaagaacaaataagtgaaatcataaatgtcagaaaaagccaatccacagcgtttaataaaggctggcactcattctcagccaaattaatgaatgaattaataccagaactatacgccacatcagacgaacagatgacgattctgacaaggttagaaaaattcaaagttaaaaagaaatcatctaaaaatataaaaaccatagatgaaaaagagataacagacgagatctataatccagtagtcgccaaatcagtaagacaaacaatcaaaataattaacgccgcagtgaagaaatacggtgactttgacaaaatcgtaatagaaatgccgagggacaaaaacgccgacgacgaaaagaaatttatagataaaaggaataaagaaaacaagaaagaaaaagatgatgccctgaaacgtgcagcttacctttataacgggacagataaattaccggacgaagtctttcacggaaacaaacagcttgagacaaaaatcaggctttggtatcaacaaggagagcgctgtctatactcaggaaaaccaataccaatacaggagctagtacataattcaaataatttcgaaatagatcatatactaccattaagcctaagttttgacgactctcttgcaaacaaagttctagtatattcatggacaaaccaagaaaaaggacaaaggactccatatcaagttatagacagcatggacgcagcttggtcattcagagaaatgaaagactatgtcctaaaacaaaaagggttaggtaaaaagaaaagagactaccttttaaccaccgaaaacatagataaaatagaagttaaaaagaaattcattgaacgaaatttagtagatacacgatatgcatccagagtcgtactaaactcactacaaagcgccctaagagaactaggaaaagacacaaaagtaagcgtagtaagaggccaatttacatcacaactacgcagaaaatggaaaatagataaatcaagagaaacatatcaccatcacgcagtcgatgcgttaataatcgcagcgagctcgcaactgaaactatgggaaaaacaagataatccaatgtttgtagattacggaaataatcaagtagtagacaaacaaaccggcgaaatactatccgtttcagacaacgaatacaaagaattagtatttcaacccccatatcaaggattcgtcaatacaatttcctcaaaaggatttgaagatgaaatactattttcataccaagttgacagtaaatacaatagaaaagttagtgacgcaaccatatattcaacaagaaaagcaaaaataggaaaagacaaaaaggaagaaacctacgtcttaggtaagataaaagatatatactcacaaaacggtttcgacacgtttgtaaagaaatataataaagataaaactcaattcctgatgtaccaaaaagatccattaacatgggaaaatgttatagaagtaatattgggagattaccctacgacaaagaaaagcgaagacgggaaaaacgatgtaaaatgcaacccattcgaagaatatcgaagagaaaacggactaatatgcaaatacagcaagaaaggaaaaggaaccccaataaaatctttaaaatactatgataagaaactaggaaactgtattgacataaccccagaagagtcacgaaacaaagtaatactacaaagcattaatccatggagagcagacgtatacttcaaccctgaaacactaaaatacgaactcatgggtctaaaatattcagatctaagttttgagaaaggaacaggaaactaccatatttcacaagaaaaatatgatgcaattaaagaaaaagaaggaattggaaagaaatcagagttcaaattcactttatatcgcaatgatttaatattaatcaaagacatagcatcaggcgaacaagaaatatatagattcctaagtcgcacaatgcctaacgtaaaccactacgtagaactcaaaccatatgacaaagaaaaattcgacaacgtccaggagctagtcgaagcactaggcgaagcagacaaagtggggcgctgtataaaaggattgaataaaccaaacataagcatatataaagtaaggacagacgtactcggaaataaatacttcgtaaagaaagaaggcgataaaccgaaactagactttaaaaacaacaagaaatga

SEQ ID NO: 5141 - RNA, 3393 nt, synthetic construct
  misc_feature 1..3393: note = Cas9 variant
  source 1..3393: mol_type = other RNA
atgaccaacggcaaaatattaggcctagacattggaatagcatcagtaggagtaggaataatagaggcaaaaacaggaaaagtggttcacgcaaactcaagactcttcagcgcagccaacgccgaaaacaacgcagagagacgcggcttccgagggagtcgaagactaaacaggcgaaaaaaacaccgagtaaaacgtgtaagagacctattcgaaaagtatgaaatagtgacagatttcaggaacttaaacctaaatccctatgagctccgggtaaaaggactgacggaacaattaacaaacgaagaattatttgccgctctacgaacgatatctaaacgaagaggaatatcatatctggatgacgccgaagatgactcgacagggagcacagattacgctaaaagcatagacgaaaacagaagattgctcaaaacaaagacccccggacaaatacaattagagagattagaaaaatacggacaactacgaggcaacttcaccgtatacgacgaaaacggcgaggcacatagactaataaatgtattctcaacaagcgactacgaaaaagaagcacgtaaaatcctggaaacacaggctgactacaataaaaaaataacagcagaattcatagacgactacgtcgaaatattaacacaaaagagaaaatattaccacggaccaggtaacgaaaaaagcagaacagactatggaagattccggacagatggaacaacactagaaaatattttcggtatcctaataggaaaatgtagcttttatccagatgaatacagggcctcaaaagcaagctacacggctcaagaatataactttctaaacgacttaaataaccttaaagtaccaacagaaactggaaaattatctacagaacaaaaagaagcccttgtagaattcgcaaaaagcacggcaacgcttggaccagcaaaattactaaaagaaatagcaaaaatactagattgtaaggtagatgaaataaaaggatacagagaggacgataaaggaaaaccagacctacacacattcgaaccataccgaaagctaaaattcaacctagacagtgtaaatatagacgacctatcccgtgaagtacttgataaactagcagatattctcacactgaataccgaacgagaaggaatcgaagacgcaattagacataacctccccaatcaatttaccgaaggacaaatatcagaaatcattaaagtacgaaaatcccaaagcaccgcatttaacaaaggatggcacagtttcagcgcaaaattaatgaacgagctcatccccgaactctacgccacaagtgatgaacaaatgactatactcacaaggctcgaaaaatttaaagtaaacaaaaagtcctctaaaaatacaaagacaatcgatgaaaaagaagttacggatgaaatatacaacccagtagtagctaaaagtgttagacaaacaataaaaataataaatgcagcagtgaaaaaatacggagactttgataaaatagtaatagaaatgcccagggacaaaaacgctgacgatgagaaaaaattcatagacaaaaggaacaaagaaaacaaaaaagaaaaagacgatgcactaaaacgagcagcatacctttataatggcacggacaaactgccagacgaagtattccacggaaacaaacaacttgaaacaaaaataagactttggtatcagcaaggggaaaggtgtctatactctggaaaaccaatcccaatacaggagttagtccacaattcaaacaactttgaaatcgaccatatattaccactttcattaagtttcgacgactccctcgcaaataaagtgctcgtttatgcttggacaaatcaagaaaaaggtcaaaagaccccatatcaagtgatagatagcatggacgcagcatggtcatttagagagatgaaggactatgtactaaaacagaaggggctaggaaaaaaaaaacgggattatttactaacgaccgaaaacatagacaaaattgaagtaaaaaaaaaattcatagaacgaaatttagtcgatactaggtatgcaagtagagtggtgctcaactccttgcaatcagcattaagagaacttgggaaagacactaaaataagtgtaatccgaggacaatttacaagccaactaagaagaaaatggaaaatagacaaatcaagagaaacataccatcaccacgcagtagatgcactaattatagcagcatcttcacaactaaaactatgggaaaagcaggacaatccaatgttcgtagattatggaaataaccaagtagtagataaacaaaccggtgagatattaagtgtttcggacgatgaatacaaagaattagtcttccagcccccgtaccaaggcttcgtaaacatgatctctagtaaaggattcgaagatgaaattttattctcttaccaagtggatagtaaatacaatcgaaaagtaagcgacgcaacaatatattcaactagaaaagctaaaattggaaaagataaaaaagaagaaacttacgtattaggaaaaattaaagacatatactctcagaacggcttcgacacctttataaaaaaatacaacaaagacaagacacagttcctaatgtaccaaaaagatcccttaacatgggaaaacgtaatagaagtaatattaagagactaccccacaacaaaaaaaagtgaagatggcaaaaacgacgtaaaatgtaaccctttcgaggaatatagaagagaaaatgggctagtctgcaaatatagcaaaaaaggcaaaggtaccccgataaaaagcctaaaatattacgacaaaaaactaggtaactgtatcgatattactcccgaaggatcaaaaaacgaagtcgtactacaaagcttaaacccgtggagggcagacgtctatttcaatccggaaacactcaaatatgaattactcggactaaaatattcagatctaagctttgaaaaaggcacaggaaaatatcacataagccaagaaaaatacgatgtaataaaagaaaaggagggaataggaaaaaagagtgaatttaaattcacactatatagaaatgatctgattctaataaaagacaccgcatcaggagaacaagaaatttatagatttttatcacgaaccatgcctaacgtgaaacactatgcagaattgaaaccatatgacaaagaaaaatttgataatgtacaagaattagtagaagcattaggagaggccgacaaagtaggcagatgcataaaagggttaaataaatcaaatcttagcatatataaagttaggacagatgtattgggaaacaaatattttgttaaaaaagaaggagacaaacctaaattagatttcaaaaacaataaaaaatga

SEQ ID NO: 5142 - RNA, 3393 nt, synthetic construct
  misc_feature 1..3393: note = Cas9 variant
  source 1..3393: mol_type = other RNA
atgaccaatggtaaaatacttggtttagatattggaattgctagtgttggagtcggaataatagaagcaaaaacaggtaaagtagtccacgcaaactcacgcctattctcagccgcaaacgccgaaaacaatgcagaacgacgaggattcagaggaagtaggcgactcaaccgaagaaaaaaacacagagttaaacgtgttcgcgacctatttgagaaatacggcattgtaacagacttccgaaacttaaacctaaatccttatgagctcagagtcaaaggactgacagaacaattaaccaatgaggaactattcgccgcactccgaacaatatcgaaacgcaggggcataagttacttagatgacgcagaggatgacagcacaggtagtacagattatgctaagagtattgatgaaaatagaagattattaaaaaccaaaaccccaggacagatacagcttgaaagattagagaagtacggacagctaagaggcaacttcaccgtatacgatgagaatggagaagctcacagactaataaacgtattcagcacatccgattacgaaaaagaagcaagaaaaatcctagaaacacaagcggattataacaaaaaaataacagcagaattcatagacgactatgtagaaattctcactcaaaaaagaaaatactaccatgggccgggaaacgaaaagtcaaggacggattatggaagattcagaacagacggaaccactttggaaaatattttcggaatcctcattggaaagtgcaacttctatccggatgaatatagggcatctaaagcctcatacacggcgcaagaatacaacttcctaaacgacctaaacaacctgaaagttccaacagaaacaggtaaactatccacagaacaaaaagaatcactcgttgagtttgcaaaaaacacagcaattctaggtccagcaaaactactcaaggaaatagcaaaaatactcgactgcaaagtagacgaaatcaaaggatatagagaggatgataaaggaaaaccggatttacacacattcgaaccctaccgaaaactcaaatttaacctagattcagtcaatattgactacttgtctagagaagtactagataaattagcagatatcttaacattgaacaccgaacgagagggaatagaagatgcaataaagcgaaacttacccaaccaattcactgaggaacaaatatcagagattatcaacgtccgaaaaagccagtctacagcctttaataaaggatggcatagtttcagtgctaaactgatgaatgaattaataccagaactctacgctaccagtgacgaacaaatgacaatactcacgagactagaaaaattcaaagtaaaaaaaaaaagctccaaaaatataaaaacaatagacgaaaaagagatcacagacgaaatatacaatccagtcgtagcaaaatccgtacgtcaaacaataaaaataataaatgcagccgtaaaaaaatacggagattttgacaaaattgttatagaaatgccccgagataaaaacgcagacgatgagaaaaaattcataaacaaaagaaacaaagaaaacaaaaaggaaaaagacgacgcccttaagagagctgcttacctatacaacggtactgataaactaccagacgaagttttccatggaaataaacaactagaaacaaaaattcgattatggtatcaacaaggcgaacgatgcttatattcaggaaaaccaataccaatacaggaactagtacacaatagtaacaattttgaaatagaccacatactaccactatcactatcatttgacgacagcctggcaaataaagtattagtatacagctggacaaaccaagaaaaaggacaaaaaacaccttatcaagtaatagactcaatggatgccgcgtggtcgttccgcgaaatgaaagagtacgtactaaagcaaaaaggcttgggtaaaaaaaaaagagactatctattaacaacagaaaacatagataaaatagaagttaaaaaaaaattcatagagagaaacctagtagatacaagatatgcaagtagagtagtgctaaattcattacaaagtgcattaagagaactaggaaaagacacaaaagtaagcgtagttcgaggacaattcacctcccaattaaggagaaaatggaaaatagataaatcaagagagacataccaccaccacgcagtagatgccttaataatcgctgcttcaagccaactaaaactgtgggaaaagcaagacaatccaatgttcgtcgactacggaaataatcaagtagtcgataaacaaacaggtgaaatcctatcagtcagcgataacgaatataaagaattagtgtttcaaccgccctaccaaggttttgtaaacacaatcagctcaaaaggattcgaagacgaaattcttttcagttaccaggtagatagtaaatacaatcgaaaagtctcagacgcaaccatctattcaacacgaaaagcgaaaataggtaaagacaagaaagaggaaacatacgtattaggtaaaataaaagacatatacagccagaatggatttgacaccttcgtaaaaaaatataacaaagataaaacacaattcttaatgtatcaaaaagaccctctaacatgggaaaacgtaatagaagtaatcctaggggactacccaaccacaaaaaaatcagaagatggcaaaaatgatgtgaaatgcaacccattcgaagaatacagaagagaaaatggcctaatctgtaaatattcgaaaaaaggcaaaggaaccccaataaagtccttaaaatactacgacaaaaaattaggaaattgcatagacattacaccagaagaatcacgtaacaaagttatcctccaaagtattaacccgtggcgagcagatgtatatttcaatcctgagacattgaaatatgaattaatgggattaaaatacagtgacttaagtttcgaaaaaggcactggcaactaccacataagtcaagaaaaatacgatgcaataaaagaaaaagaaggaataggcaaaaaatcagaattcaaatttacactttaccgaaacgatttaatattaataaaagatatagcaagcggagaacaggaaatatacaggttcctatccagaacaatgcctaacgtgaatcattacgtagaattgaaaccatacgataaagaaaaattcgataatgttcaagaactagttgaagccctaggtgaagctgataaagtaggaagatgcattaaaagtctaaacaaaccaaatataagcatctacaaagttagaacagacgtattagggaataaatactttgtaaaaaaagaaggagataaaccaaaattagattttaaaaacaacaaaaaatga

SEQ ID NO: 5143 - RNA, 3393 nt, synthetic construct
  misc_feature 1..3393: note = Cas9 variant
  source 1..3393: mol_type = other RNA
atgagcaacggcaaaatattaggcttagacataggtgtagcatcagtcggtgtaggaatcatagacgcaaaaacagggaaagtaatacatgcctcaagcagactattcagcgccgcaaacgcagagaataacgcagaaagaagaggatttaggggagcaagacgattaacaaggagaaagaaacatcgaattaaaagggtaagagacttattcgagaaatatgaaatagtaaccgatttttccaatcttaatttaaatccctatgaactgcgcgtcaaaggcttaacagaacaattaacaaatgaagaattattcgcggcattacgaacaatagcaaagagacgcgggatatcctatttagatgatgcggaagacgatagtacaggttcaagcgactacgcaaaaagtatagaagaaaaccgacgtctactcaagaatatgaccccaggacagatacaattagaaagactggaaaaatatggacaattaaggggaaatttcaccgtatatgatgaaaatggagaagcgcacagattgataaacgtcttttcaacatcagattacaagaacgaagctagaaaaatactagaaacgcaatcaaattataataaacaaatcacagatgaatttattgaagactacatagaaatcctaactcagaaaaggaaatactaccacggacctggaaatgaaaaatcaaggactgactacggacgatataggaccgatggtacaacattagaaaatatcttcggtattctaataggaaaatgcacattttacccggacgaatacagaacctcaaaagcctcatacacagcccaagaatacaatttcctaaacgacttaaacaacctaaaagtacctacagaaacaggaaaattatcaactgagcaaaagcattacctcgtcgacttcgctaaatcatcaaaagcattaggagtagcgaagttacttaaagaaatcgcgaagatagtcgaatgttccgtagatgatatcaagggatatagagaagacaacaaagggaaaccggatctacacacgttcgaaccataccgaaaacttaaattcaatttaagtttgatcgacatcgacgaactaagccgagaaaccctagataagctagccgatattctcacattaaacacggagagagaaggaatagaagacgcaataaaaagaaatctaccaaatcaattcacagaagaacaaatagtggaactggtaaacgtaagaaagaaccaatcgtcagcgttcaacaaaggttggcactcatttagtgtaaaattaatgaatgaactcataccagaactctatgcaagttcggaagaacaaatgacaattttaacgagactagaaaaattcaaagttaacaaaaagtccagcgaaaacacaaagacaataaacgagaaagaaataacagatgaaatatacaaccccgtagtagcaaaatccgtgtcacaaacagtaaaaataataaatgcagcagtaaagaaatatggcgactttgacaaaatagtaattgaaatgcctagggacaaaaacgcggatgacgaaaagaaattcatcgacaagaaacaaaaagaaaacgctaaagaagtagaagatgcactaaaaagggcggcatatctctataacggaaccgataaattacccgacggagttttccacggtaacaaacaattaaaaacaaaaatccgactatggtaccaacaaggtgaaagatgtctgtacagtggaaaaccaatatcaatccaagacctcgttcataactcaaacaacttcgaaatagaccatatactcccattaagtctgagctttgatgattcactagctaataaggtgttagtgtacgcatggaccaatcaagaaaaaggacagaaaacgccctaccaagtcatagacagcatggatgcagcatggagtttccgagaaatgaaagactacgttttaaaccaaaaaggaataggaaagaagaaaagagaatacttattaacaacggagaacatagataaaatagaagttaaaaagaaatttatagaaagaaacctggtagacacacgatatgcaagcagagtagttctaaattctatacaagcagcactaaaagaactcgataaagatacgaaagtatcggtgatacgaggacaatttacatcgcaactcagacgaaaatggaaaattgataaaagcagagaaacataccatcatcacgcagtagacgcattaattattgcagcgtcttcccaactaaaactatggcaaaaacaagaaaatccaatgttcgtagattacggagagaatcaagtcgtcaataaagaaaccggtgaaatattatcagtatcagatgacgattataaggagctagtttttcaaccaccctaccaagggtttgtgaacactatatcatctaaggctttcgaagatgaaatcttattcagttatcaagtagacagcaaatataaccgcaaagtaagtgatgcaactatatatagcacaagaaaagcaaaattaggcaaagacaagaaagaagaaacatacgtacttggaaaaataaaagacatatacagtcaagacggatttgatgcgtttataaaaagatataagaaagataaaacacaatttcttatgtatcaaaaagacccagtaacctgggaaaacgtcatagaagtaatactacgagactatccatcagaaaaattgtcagaagacggaaagaaaaacgtaaaatgtaacccatttgaagaatacaggcgagaaaacggattgatatgcaaatatagcaagaaaggaaaagggacaccaataaaatcattgaaatattatgacaagaaattaggaaattgtatagacataaccccaaaaggcagcaaaaacgaggtagtactacaaagccttaacccgtggcgagctgatctatacttcaatccagacaccttgaaatatgaactcatgggactaaaatacagtgacttgagctttgaaaaaggaactggaaaatatcatattagtcaagaaagatatgacgaaataaaagtcaaagaaggtatagggaaaaacagcgagttcaaattcacactatatagaaatgatctgatcctgataaaagatacggaatccggagaagaagaattataccgatttctatccagaactatgcccaacgtaaaacattacgtagaacttaaaccctacgacaaagaacgatacgacggtggtcaagaattaatgaaagtatttgggaatgtagcgaatggaggtcaatgccttaaatctctaaacaaatctaacctatcaatctacaaagtaaggacggatgtattaggcaataaattctttataaagaaagaaggagacaaaccaaaattagactttaaaaacaataagaaatga

SEQ ID NO: 5144 - RNA, 3393 nt, synthetic construct
  misc_feature 1..3393: note = Cas9 variant
  source 1..3393: mol_type = other RNA
atgacaaatggaaaaatattaggtctagatataggaatagcgtcggtgggagtaggaataatagaagcgaaaactggaaaagtagtacatgcaaacagccggttattcagtgctgccaacgctgaaaacaacgccgaacgcagaggtttccgtggatcaaggagattaaacagaaggaagaaacatcgagtaaaaagagtacgcgacttattcgaaaaatacggaatagtaaccgatttcagaaacctgaatctaaacccatacgaattgagagtaaaaggactaacggaacaactcaaaaatgaagaactttttgcagcactgagaacaataagcaaaagacgaggaataagctacctagacgacgcagaagatgacagcacgggaagcaccgactacgcaaaatccatagatgaaaacagaagactactcaaaaataaaacaccaggacaaatccaattagaacgactggaaaaatatggacaactacgaggaaacttcacagtttacgatgaaaatggtgaagcacacagattaataaatgtgttttcaacctcagactatgaaaaagaagccaggaaaatactagaaacacaagcagattataacaagaaaataacggcagagttcatagatgattatgtagaaatcctaactcagaaaagaaaatactatcacggtccaggaaatgaaaaatcgagaacagactacggacgattcagaacagacgggacaaccctagaaaacatatttggaatacttattgggaaatgtaatttctatccagacgaatatagagccagcaaagcatcatataccgcacaagaatacaattttctaaatgatttaaataatctcaaagtatcaactgaaacaggaaaactgagtacggaacaaaaagaaagcctagtcgaatttgccaaaaatacagccacacttggacctgcgaaactactaaaagaaatagcaaaaatattggattgcaaagtggacgaaattaaaggatatagagaagacgacaaaggcaaacccgacttacatactttcgaaccgtacagaaaactcaaattcaacttagaaagcatcaatatagacgatctaagccgagaagtaatagacaaattagcagatattctgacactcaatacggaaagggaaggaatagaagatgccattaaacgaaatctaccaaatcaattcaccgaagaacaaataagtgaaatcatcaaagtgcgaaaaagccaaagtactgccttcaacaaaggctggcatagtttctcagcaaaactgatgaacgaactcattccagaattgtatgcgacatccgacgaacaaatgaccatattaacaagactagaaaaatttaaagtgaacaagaaaagttccaaaaatacaaaaactatagacgaaaaagaagtaacagacgaaatatataacccagtagtagcaaaatcggtaagacaaacgataaaaataataaatgctgctgttaagaaatatggagacttcgacaaaatagtaatagaaatgccaagggataaaaatgctgatgatgagaagaaattcatagacaaaagaaataaagaaaacaagaaagaaaaagatgatgcgttaaaacgagcagcgtatttatataactcttcggataaactcccagacgaagtattccatggaaacaaacaattagaaacaaaaataagattatggtaccaacaaggtgaaaggtgcttatactcaggcaaaccaataagtatacaagaattggtccacaactcaaacaactttgaaatagatcacatactaccactaagcctatcatttgacgattccctagctaataaagtattagtttatgcatggacgaaccaagagaaaggacagaaaacgccataccaagtcatcgactccatggatgcggcctggagcttccgagaaatgaaagactacgtactaaaacaaaaaggactaggtaaaaagaaacgggattacctattaacgacagaaaacatagataaaatagaggtcaaaaagaaatttattgaaagaaatctggtagacacacgatatgcatcaagggtagtactaaacagcctacaatcagctttgagagagctcggtaaagacacaaaagtaagcgtagtaagaggacaattcaccagccaactcagaagaaaatggaaaatagacaaaagtcgagagacatatcatcatcatgctgtagacgcattgataatagccgcctcatcacaattaaaactatgggaaaaacaagacaacccaatgttcgtggattacggcaaaaaccaagtagtcgacaaacaaactggtgaaattttatcagttagtgatgatgaatacaaagaattagtatttcaacccccataccaaggattcgtcaacaccataagctcaaaaggatttgaagacgaaatattattcagctaccaagtagacagcaaatacaaccgcaaagtaagtgacgccacaatatactctacgagaaaggcaaaaataggaaaagataagaaagaagaaacctatgtactaggaaagataaaagacatctacagtcaaaacggtttcgacacattcatcaagaaatataacaaagacaaaacacaatttttaatgtaccaaaaggacagcctgacttgggaaaatgttattgaagtaatattgagagattacccaactacaaagaaatccgaagacggcaaaaacgatgttaaatgtaatcctttcgaagaatacagaagagaaaatggattaatatgtaaatacagcaagaaaggaaaaggaacacccattaaatccttaaaatattacgacaagaaattaggaaactgtatcgacatcacaccagaagagagcagaaacaaagtaattctacaatcaatcaatccctggagagcagacgtatacttcaatccagaaactttaaaatacgaactcatgggactaaaatattcagatctatcatttgagaaaggaaccggaaactaccatatatcccaagaaaaatacgatgctataaaagaaaaagaaggaataggcaagaaaagtgagttcaaatttacgttataccgaaacgatttaatactaataaaagacatagcctcaggagaacaagaaatctatcgattcctatcaagaacaatgcccaatgtaaaccactacgttgaattaaaaccttacgacaaagaaaaatttgacaatgtacaagagcttgttgaagcactaggagaagcagataaagtcggaagatgtattaagggactaaataaacccaatatatctatctataaagtaagaactgacgtattaggaaacaaatattttgtcaagaagaaaggcgacaaaccgaaactcgatttcaaaaacaacaagaaatga

SEQ ID NO: 5145 - RNA, 3393 nt, synthetic construct
  misc_feature 1..3393: note = Cas9 variant
  source 1..3393: mol_type = other RNA
atgacaaacggcaaaatattaggacttgacataggaattgcatctgtcggagttggaataatagaagcaaaaacaggcaaagttgttcacgccaactcacgacttttttcagcagcaaatgctgaaaataatgcagaaaggaggggattccgaggatctcgaagattaaatagaagaaaaaaacatcgagtaaaacgagtacgtgacctattcgagaaatacggtatagttaccgacttcaggaatttaaacctgaacccatacgaactgagagtgaaagggctaacagaacaactaactaacgaagaactcttcgcggctctaaggacaatatccaaaagaagaggaataagttatttggacgatgcagaagacgattcaacaggaagcacagattatgcaaaatcaattgacgaaaacagaagattgcttaagacaaaaacccccggccaaatacaattagaaagattagaaaaatacgggcaactgagaggaaatttcacagtctacgacgaaaatggagaagcacatagactgataaatgtattcagtactagcgactatgaaaaagaagcaagaaaaatacttgaaactcaggcagactacaataaaaaaattacagcagaattcatagacgattacgtagaaatactaacccaaaaaagaaaatactatcacggtcctggaaatgaaaaatcaagaactgattacgggcggttcagaacagacggcacgacactagagaacatatttgggatattaatagggaaatgttcattctaccctgatgaatatagagcttcaaaggcaagctacactgcacaagaatacaatttcctaaacgatctaaataatctaaaagtccccacagagacaggaaaattatcgacagaacaaaaagaagcattagtagaattcgcaaaatccacagccacattgggtccagcaaaattattaaaagaaatagcaaaaatactcgattgtaaagtcgatgaaataaaagggtatagggaagacgacaaaggaaaaccagatttacacacattcgaaccatatcgcaaactaaaattcaacttagattctgtcaacattgactacttaagccgagaggtgctagataagctcgcggggatactaacactgaatacagaaagagagggaatagaagatgcaataaaaagaaacttaccaaaccaattcacagaagaacagatatcagaaatcatcaacgtaaggaaaagtcaatcaacggcattcaataaaggttggcattcgttttccgcaaaattgatgaacgagctaataccagagctctacgcaacatcagacgaacaaatgacaatcttaacaagattagaaaaattcaaagtcaaaaaaaaatcaagtaagaacattaaaacaatcgacgaaaaagaaattacagacgaaatctataacccggtggtagcaaaatccgttagacaaaccattaaaataataaacgccgcagtaaaaaagtacggagactttgataaaattgttatagaaatgccaagagacaaaaatgccgacgatgagaaaaaattcataaacaaaaggaataaagaaaataaaaaagagaaagacgacgcattaaaacgagccgcttacttatataacggaacggataaactacctgacgaagtcttccacggcaataaacaacttgaaacaaaaatccgactatggtatcaacaaggggaaagatgtttatattctggcaaacctataccaatacaagaactagtacacaattcaaataactttgaaatagatcacatactccccttatcactatcatttgatgacagcctagctaacaaagtactagtatactcatggactaatcaagaaaagggtcaaaaaacaccatatcaagtcatagacagtatggacgcagcatggtcctttcgagaaatgaaagaatatgtactaaaacaaaaaggactagggaaaaaaaaaagagactatctattaaccaccgaaaatatagataaaatcgaagtaaaaaaaaaattcatagaaagaaatctcgtagacacgagatatgcatcaagagtcgtactaaacagtctgcaaagcgctttaagagaactaggtaaagacaccaaagtctcagtcgtcagaggtcaattcacaagtcaattaagaagaaaatggaagatagataaatcaagagaaacatatcaccatcacgctgtagacgcactaataatagcagcaagttcacaattaaaactatgggaaaaacaagacaatccaatgttcgtggattatgggaataaccaagtagtagacaaacaaacaggggaaatcctgagtgtatccgataacgaatataaagaattagtatttcaacccccttatcaaggatttgtcaacacaatatcaagcaaaggttttgaagacgagatacttttctcataccaagtagactcgaaatacaatcgaaaagtgtccgacgccactatatattctaccagaaaagcaaagatcggaaaagataaaaaggaagagacttacgtattaggaaaaataaaagatatctatagtcagaacggatttgatacttttgtaaaaaaatataataaagataaaacgcaattcctaatgtatcagaaagatccattaacatgggaaaacgttattgaagtaatcctaggtgactacccaacaacaaaaaaatcagaagatggaaaaaacgacgtaaaatgtaacccattcgaagaatacagaagagaaaacggactaatatgtaaatattcaaagaaaggtaaaggcacaccaataaaatcactaaaatactatgacaaaaaattaggcaactgtatagacataactccagaagaatcacgaaataaagtaatattacaaagtataaatccctggcgagcagatgtctatttcaacccagaaacattaaaatatgaacttatgggactaaagtattctgatctttccttcgaaaaagggacagggaactaccacatatctcaagagaaatacgacgctattaaagaaaaagagggcataggtaaaaaaagcgaatttaaatttactctctatagaaatgatctaatattaataaaagatatagctagtggagaacaagaaatttatcgattcttatcccgaacaatgccaaacgtaaaccactatgtcgagctaaaaccctacgacaaagaaaaattcgataacgtacaagaattagtagaggcactaggtgaagcagataaagtggggcgatgtataaaaggtttaaataagccaaacataagtatatataaagtacgtacagacgtactcggaaataagtactttgtaaagaaagaaggcgacaaaccaaaattagactttaaaaacaacaagaaatga

SEQ ID NO: 5146 - RNA, 3396 nt, synthetic construct
  misc_feature 1..3396: note = Cas9 variant
  source 1..3396: mol_type = other RNA
atggcccaacacgtttttggtcttgatataggcatagcgagtgtaggatgggccatcttgggggagcaaagaatcatagatttaggagttagatgttttgataaagcagagaccgcgaaagaaggtgatccccttaatctaacaagaaggcaggcaagattattaaggaggaggttatacaggagagcctggagactcacacaacttagtaggttgctaaaacgaaaaggattaatagcagatgccaaattatttgcaaaagctcctagttacggagatagtgcatgggaactaagacgacaaggtctggatagactattaacaccgctagaatgggcaagagtaatctatcatcaatgtaaacacagaggcttccactggacctcaaaagcagaagaggcaaaagcagactctgacgctgaaggaggaagagtaaaacagggacttgcacacaccaaagcattgatgcaagcgaaaaactatagaagtgcggcagaaatggtattagcagaatttccagatgcccaaagaaacaaacgaggtcaatatgataaagcattaagtagagttttactaggagaagaattggcattattatttgctacacagagaagactgggcaacccacacgcttctgacttctttgaaaaacttatattaggagatggagaccgtaaatctggattgttttggcaacaaaaaccagctctaagtggtgcagatctacttaaaatgcttggaaaatgcacttttgaaaaaggagaataccgtgcaccaaaagcctcatttagcgtagagcgacatgtgtggttgacaagactaaataatctaagaatagtagtagacgggagatcgaggccactaaacgaagctgaaagacaagccgcactcctacttccatatcagacagaaacatcaaaatacaaaacactaaagaatgcctttatcaaagccggtctatggggagatggtgttagattcggaggactagcatacccttcacaagctcaaattgacgctgagaaaacgaaagacccggaagaccaattcctagttaaattaccggcctggcatgaattaagaaaggcatttaaagcagctgggcacgaagcattgtggcaacaaatctctacaccagcgttagatggagatccaacacttctagatcaaatcgccacggtattatcggtatacaaagacggggccgaagttgtgcaacaactaagacaactcgcattgcctgagccagcagcatcaatagctgtactagagaaaatatcatttgataaattttcatcattatcactcaaagccttaagaagaatagtacctttaatgcaaagtggactcagatatgatgaagcagtagcgcaaatacccgagtacggacaccacagtcaaaggatagaaccaggagccgctaaacatttatatctgcccccattttatgaagcacaaagaaaatacgcgggaaaaggagatcatatagggtccatgcaatttagggacgatgcagatatcccaagaaatccagtcgttcttcgagctctaaaccaagctcgtaaagttgtgaatgcattaatacgtgaatatggatcaccaatagcggttaatatagaaatggcacgagatttgtcaaggccacttgatgaaagaaataaagttaaacgagcacaagaagaatttagggatagaaatgatcgggcaagaagcgagtttgaaagagactttggatataaacctaaagcagccgccttcgagaaatggatgttataccgtgaacaactaggacaatgtgcttactcccaacaacctctagacatacaacgggtacttgatgatcataattatgcacaagtagatcatgcgttaccttactctagaagttatgatgattctaaaaataacaaagttttagttcttacacatgaaaaccaaaacaaaggaaatcggactgcattcgaatacttaacaagttttccagatggggaagatggagaaagatggagaacattcgtggcatgggttcaaggaaataaggcttatcgaatggccaaaagaaataggctcctaagaaagaactatggggtggacgaatcaaaagggttcatagatcgaaacctaaatgacacaagatacatatgcaaattctttaaaaattatgtagaagaacacttgcagctggcggcaagggctgatggagatacagcaagaaggtgcgttgttgtaaatggacaactaacagcgtttttacgagcgcgatggggactaactaaagtaagaggagattcagaccgacatcatgcactggatgcagcagtagttgcagcatgcacacatggaatggtaaaagcgcttgcagattattcccgaagaaaagaaatatcgtttctacaagaaggatttccagatcctgaaactggagaaatattaaacccagcagcattcgatagagcaagacaacattttccagaaccatggacacattttgcacacgaacttaaagcaagactatttacagacgacttagctgctctacgggaggatatgcaacgattgggtagctatacaaccgaagacctaggtagattaagaacattatttgttagtagagctccacagcgaagatcagggggagcagtacacaaggaaaccatttacgcccaaccagagtcactaaaacagcaagggggcgttattgaaaagattttattaacatctctgaaactacaagattttgataaattactaaatccagaatcaaatgaccattttgtcgagccgcatagaaacgagagactttacgcagcaattagacaaaggcttgagcaatttggaggcagagcagataaagcatttggaccggataacttatttcataaaccagacaaaaataaccagccaacaggaccagtagtcagatctataaagttagtaagaggaaaacagactggaatcccaataagaggtggtttggctaagaacgattcaatgcttcgtgttgacatattcacaaaagcaggaaaatttcatctcgttccagtttatgtacatcatagagtaaccggattacccaatcgagcaatagtagcgttcaaagatgaagacgaatggacgctcatagacgaatcctttgcttttcttttctcagtatacccaaacgattatgtaaaagtaacactgaagaaagaacaacaaagtggatattattcaggcgcagacagaagtacaggtgcaatgaatttatgggcgcacgatagagcggcatctgtaggaaaagatggattaatacgtggtattggtgttaaaacagcattaagtgtagaaaaattcaatgtagatgtattaggtagaatttatctagcacccccagagacgagatctggtctggcctga

SEQ ID NO: 5147 - RNA, 3399 nt, synthetic construct
  misc_feature 1..3399: note = Cas9 variant
  source 1..3399: mol_type = other RNA
atggcgcaatacgtattcgggctagatataggaatagccagtgtcggttgggcagtattagatgcgcaaagaatagtcgacttaggagtaagatgtttcgataaagcagaaacagcgaaagaaggcgatccactaaatctaacaagaaggcaagcgaggttgctaagacgaaggttatatagacgagcatggagactaacacaattagcgcgtctgtttaaaagagaaggattaatagacgacgccaaacttttcgcaaaggcaccaagttggaccgaaaatgcatgggaactcagactaagaggactagaccatctgttaacaccattagaatgggcaagagtgatatatcatctatgtaaacatcgaggatttcattggacttcaaaagctgaagaagcgaaagctgaatcagacgcagaaggtggtagagttaaacagggattagcacacacaaaagcactaatgcaagttaagaattatagatctactgcagaaatggtgcttgccgaatttccaggagcacaacggaacaaaagaggccaatatgacaaagctctatcacgagtcttattaggtgaagaacttgctttactatttgcgactcaaagaagactaggaaatccccacgcatctgaacattttgaacagcttatactcggacacggagatagaaaaagtggactattttggcaacaaaaaccagcgttaagcggtgccgatttattaaagatgcttggaaaatgcacattcgagaaaaccgaatacagagcgccaaaagctagctttagtgctgaaagacatgtatggttaacgagacttaacaatttacgcattgtggttgatggcagagcacgtccattaaatgacgcagaaagacaagcagcactcctattgccatatcaaacggaaactttcaaatacaaaacattaaaagccgctttcgtcaaagttggtttatggggtgatggggtacgttttgggggactagcatacccatcccaagcacaagccgaagcggaaaaagccaaggatcccgaagaccaattcctggtgaaactaccggcatggcatgaattacgaaaagcatttaaagcagcaggacatgaagcattatggcaacaaatctccatgcccgcattagaagaagacccaactttgctagatcagatagcgactgtattgtcagtatacaaagacggaacggaagtggtacagcaactacgtcaattagctttgccggaacccgatgcaagtatagcggtcttagaaaagattagatttgataaattttcaagtctttccctaaaagctctaagaagaatagtgccactaatgcaaggcggattaagatatgatgaagcagtggcacaaataccagaatatggacatcacagccaaagaattgacccaggagcgacaagacacttatatctaccacctttctacgaagcacaacgaaagtatgcgggtaaaggggatcgaataggatcgatgcaatttcgagaagatgcagatgtaccaaggaatcctgtcgtcttaagagcattaaatcaagccaggaaagtagttaatgcactaataagagaatacggaagccctgtagcagtaaatatagaaatggcaagagatctgagtagaccactagatgaaagaaataaagtaaaacgagctcaagaagaatttagggatcggaacgataaagcgcgttcagagttcgaaagagatttcggatataaaccaaaaggagctgtgtttgaaaaatggatgttatacagagaacaactcggacagtgtgcatacagccagcaaccacttgacatacagagagtgttagatgaccctaactatgcacaagtagatcatgcacttccatatagtaggtcatatgatgatagtaaaaataataaggtgttagtgttaacgagagagaaccaaaataaaggtaatagaaccccattcgaatatttaacatcattcccaggcggtgaagacggagagcgatggagagcttttgtagcatgggtacaaggtaacaaagcatacagaatggcaaaaagaaacagattgttgcgaaagaactatggaacagacgaatcaagaggcttcatagatagaaacctaaacgacacaaggtacatatgtaaattctttaaaaattacgttgaggaacatttacaattagcagcaagaacagacggagatacggcacgacgatgcgtcgtcgttaatggacaactaacagcatttttgagagcaagatggggactcgcaaaagtgcggggagatagcgaccgtcaccacgcattggatgctgcagttgttgcagcatgtacccatggtatggtgaaagccttagcagattatagcagaagaaaagaaatagcctttcttcaggaaggtttcccggatccagaaaccggagaaattttgaacctcgcagcgttcgatcgagcgcgagaacattttccagaaccctggccacatttcgcacacgaattaaaggctagattatttatagatgatttagtagcactgagagaagatatgcaacacctgggtagctatgcacaagacgacttggacagactcagaacactattcgtatcgagagcaccacaaagaagaaatggaggagcagtccataaaggaactatatatgcacaacctgagaatctcaaacaacaaggctcaacaatagagaaaatattattaacaggattaaaactacaagacttcgacaaactattaaatccagaatcaagcgaccactttgtagaaccacacagaaatgaaagattatatgcagccataagaagaagattagaagagttcggtggtaaagccgacaaagccttcggaccagataaaccattctacaaacccgataaaaatggacagccaacgggccccattgtaagatcaataaaacttgtaagaggtaaacaaactggaataccaatccgaggaggattggctaaaaatgattcaatgctaagagtcgatgtgtttaccaaagcaggaaagtttcatcttgtaccagtatatgtacatcatagagtaactggactgccagatcgagcaatagtagcatttaaagacgaagaagaatggaccttaatagacgaatcatacgcttttctctttagtgtgtatccaaatgattttgtatgtgtgcaacaacgaggtaaacccctaatagaaggatactacgcaggacttgatagagcaaatggaaatattaacgtctgggcgcacgacagagccgcaagtgtaggtaaagacggattaataagagggataggagtaaaaaccgctctatcattagaaaaactaaacgtggacgttttgggaagaatatatccagcacccccagaaactagacgagggctggcttga

SEQ ID NO: 5148 - RNA, 3399 nt, synthetic construct
  misc_feature 1..3399: note = Cas9 variant
  source 1..3399: mol_type = other RNA
atgaaaaaaatcttaggcgtagacttaggcataacatctttcgggtacgcaatcttacaagaaacaggtaaagacttatatcgctgcttagacaattctgtagtaatgagaaacaatccttacgacgaaaaatcaggcgagagcagtcagtctataaggtctacacaaaaatcaatgagaagactaattgagaaaagaaaaaaaagaataagatgtgtcgctcagacgatggaaagatatggaatactagactactcagaaacaatgaagataaatgacccgaaaaacaatccgataaaaaataggtggcaattaagggcagtagacgcatggaaacgaccactatcgccacaagaattatttgcaatcttcgcacacatggcaaaacacagaggatataaaagtattgccaccgaagatttaatatacgaattagagttagaactcggattgaacgatccagaaaaggaatcagaaaaaaaagcagacgaaagacgccaagtgtacaacgcacttcgccatttagaagagttaagaaaaaaatatggcggagaaacaattgcacagacaatacacagggcagttgaagcaggtgacttaagatcgtatagaaaccacgacgactatgaaaaaatgatacgacgagaagatatagaagaagaaatagaaaaagtgctattaagacaggccgaattaggcgcgttaggccttcccgaagaacaagtcagcgaattaatcgacgaattaaaggcatgtataacagatcaagaaatgccaactattgatgaatcactattcggaaaatgtactttttataaagacgaattagccgcgccagcatattcttacctttatgatctatatagactatacaaaaaattagcagatcttaatattgacggatacgaagtaacacaagaagacagagaaaaagtaatagaatgggtcgaaaaaaaaatagcacaaggaaaaaatctcaaaaaaattacacacaaagatctaaggaaaattctaggattagcaccggaacaaaaaatattcggagtagaagatgaaagaatagtaaaaggaaaaaaagaaccacgcacattcgtaccgtttttctttcttgccgacatagccaaatttaaagaattgtttgcatcaatacaaaaacaccctgacgctttacaaatattccgcgaattagcagaaatattacagcgaagcaaaacaccacaagaggcactagaccgcctgagggcactaatggcgggaaaaggtatagatactgacgaccgagaacttttggaactatttaaaaataaaagatcaggaacaagagaattaagccacagatatatcctagaagcccttccattattcttagagggttatgatgaaaaagaagtacaacgtatcctaggctttgatgatagagaggattactcacgatatccaaaatcactacgacacctccatctacgagaaggaaacctattcgaaaaagaagaaaatccaattaacaaccacgcggttaaaagcctagcctcttgggcgttaggactaatagctgacctaagctggagatacggcccattcgatgaaataatactagagacaacaagggatgctctacctgaaaagattaggaaggaaatagataaagcaatgagggaaagagaaaaagcgctggataagataataggaaaatacaaaaaagaattcccttcaattgacaaaagacttgccagaaaaattcaactatgggaaagacaaaaaggactcgacttgtactcaggaaaggtaattaatctctctcaactgttagatggatcagccgatatagaacatatagtaccacaatccttaggagggctatcaacagattataataccattgttacactaaaaagcgtaaatgcagcgaaaggaaatagattacctggagattggctggcaggtaatcccgattatagagaaagaataggaatgcttagtgaaaaaggactaatagactggaaaaagagaaaaaatctcttagcccaatcgctagacgaaatatacactgaaaatacacatagcaaaggaataagagctactagctatttagaggcattagtagcacaggttttaaaaaggtattatcctttcccagaccccgaactccgaaaaaatggaataggcgttcgaatgataccgggtaaagtaacctcaaaaacacgaagtttacttggaattaaaagtaaatcacgagaaacaaacttccaccatgctgaagacgctttgatattatcaacactaacaagaggatggcaaaatagactccacagaatgttaagggataactacggaaaatccgaagcagaactaaaagagttatggaagaaatacatgcctcacatagaaggcctaacattagcagattacattgatgaagcattcaggagatttatgtcaaagggtgaagaaagcctgttttacagagacatgtttgacacaataagatcaataagttattgggtagacaaaaaaccattatcagcgagttcacataaagaaacggtgtattcatcaagacatgaagtgcctaccttaagaaagaatatactagaagcattcgatagtttaaatgtcataaaggatcgacataaactgactacggaagaatttatgaaaagatatgataaggaaattagacaaaaattatggttacaccgaataggtaatacaaacgatgagagttatcgcgctgtcgaagaacgagcgacacagatagcacagatcctcacacgctatcaattaatggacgctcagaatgataaagaaatagatgaaaaattccaacaagcactaaaggaattaataacatcaccaattgaagtaacagggaaactcttgcgcaaaatgagatttgtgtacgataaactaaatgcaatgcaaatagacagaggattagtagaaactgataaaaatatgctcggaatacatataagtaaaggcccaaacgaaaaattaatatttagacgaatggacgtaaacaatgcacatgaacttcaaaaagaaagaagcgggatactatgctatcttaacgaaatgttattcatattcaataagaaaggactaattcattatggatgtctaagaagttatttggaaaaaggccagggatccaagtatatagctttatttaacccacgatttccagcaaatccaaaagcacaaccctcaaaatttacttcggacagtaagataaagcaagtcggaataggatcagctacaggcataattaaagctcacttagatctagatgggcatgtaagatcctatgaagtatttggaacacttcccgaaggatctatcgaatggtttaaagaagaaagtggttatggacgagtagaagacgacccccaccactga

SEQ ID NO: 5149 - RNA, 3402 nt, synthetic construct
  misc_feature 1..3402: note = Cas9 variant
  source 1..3402: mol_type = other RNA
atggatttaaattatagaataggactcgacatcggtatagcctcagtcggctgggcagtactagaaaacaattcaaaagatgaaccagttagaattgtcgacctaggagtacgcctatttgaagcagcagaagtgccgaaaactggagcagctttagctgaacctcgaagggaagctagaactactagaagaagattacgcagacgaaaacatagattagaaagaatgaaatggttactacaagaatacgggttaatacaaacggaagagtttatgaaacgatatcacagcgcaggtctacccgacgtctataggttaagatacgaaggactagagagaaaactaaaagacgaagaactagcgcaaatattaattcatatagggaaacatagaggctttcgctccacaaggaaagcagaactaaaagacaaaaacgataaagagactggtgctgtattatcagcaaccagagaaaacgaaaaactaatggaggaacatggctatcgaacggcaggagaaatgatttacaaagacgataaatttagaacgggctgcacatggaaagaagaaggatatagattaacacctagaaacaaagaaggagattataaaaatacgatgctaagagcattattagaggatgaggttaaagtcatattcgattgccaacgaaaatttggtaatcaaaaagcatcagaagaactggaaaaagcatatttagcaataatgacatcacaaagaagtttcgatatgggacccgggaaacaacctgatggaagtgcaagtccgtatgccatggaaggtttcggtgaccgagtaggattatgtgcactagaaccacgagagaaacaagaaccaagagccccaaaagcagcctatacctcagaattgtttgtagcattacagaaaataaatcatttacgcatcacagagaaaaatggaaaaggcagaggattaacaagcgaagaaagagaaagacttagcgacctactacataaaaagaaagaattaacttacggcgcagtaaggaaagaattgcaattagacctacgatataggtttaatactttgaattactctagcaagaaaatgactgaagaagagaaaataaaagatgccgaaaaagccaaattcgtatcaatggtaagccactatgaatatagaaaaagaatgagcggtatgttagaacaattatcaccagaagaacaagccgacctaatggatgaagtagggaaaatcttaacattatacaaaaatgacgatacaagatctagagaatttcaaaaattaggactagattctgaaataacagaagaacttttagaactaaatccaagaggatttcaacatgtttctctcaaagctatgaagaaattaatgccatatttaaaagaaggattaacttatgacaaagcatgtgcagaagctggatatgacttccaaggaagtgtacaaaaagaaaggagtagactactaaaaggaaaagaaataactgatataataaatgatataaacaatcctgtagtaaaacgttcagtcagtcaaaccgttaaagtaataaatgctattatacaaaaatatggctcaccacaagcagtgaatatagaattagctcgtgaaatgtcaagaaattatgatgaaagaaggaaaatggagaaacaaatgaaagatagacaatcagaaaatgaaagagcaaagaaagaaattcaagaattaggaaatgcctttccaactggacaagatatactgaaatacagattgtggcacgaccaggatggtatttgcatgtacagcgccaaaagaataccactggcagaactctttacaggagcttatgacatagatcatatactaccatacagcataactttcgacgattcatacaggaacaaagtgctagttacaagtgaagaaaatagacaaaaagggaatcgaataccttatgagtatttcggatcagactcagaaagatggagcaaattcgaaacattagtcaattcaagaattagagattaccgaaaacaacaaaatctcctaaaacagtcattcacagaggaagaaagaaaagagtttaaacagaggaatttaaatgatacaaaatatataactagggttatttacaatatgattagagagaacttagctttagcaccatataactcaccgggaaagaagaaacaagtgtttgcagttaacggaggggttacagcataccttaggaaacgctggggaatgtcagcaaaagatagaagtatagatacacaccacgccagagacgctgttgtaatagcttgctgcaccgacggcatgatacagaaaatatctcggaatattcaaggtcgcgaactattatacgcccgagggtttacagcagtggacgtagaaaccggagaaaaatttacgagggatgattttaccagagatcaatgggatgagatatttggagtacaagtaccaaaaccatgggagtattttaatgaagaacttgacatacgactaggagaaaatccagttgagttcatagaaactcatagtgatgtcagccgaaaactagactaccccgcatggttttatgaaaataatataataagaccagtttttgtatcaagaatgcctaaccgaaaagtaacaggagctgcacacgcggatacgattagatccccaagacattatcaagaaacaggtagtgtactaacaaaaacagcattaatagatttaaaactaaataagaaaacgggagaaatagaaaactactataaacctgaaagtgatacactattatataatgcactgaaagaacgactagaactttatggaggtgacggaaagaaagcgttcgaagaaccattctacaaaccgaaagcagatggatctcgaggaaatttggtaagaaaagtgaaaacctatgacaaactaaccctaggtgtatacgtcaatagtcaacatggtatcgcagccaatgcaaatggttctatggttagggtagatgtattcagagtttccgggaaatactactttgtcccagtatatatagcggacgtagtacgcaaacgattaccaatgaaagccgtcgtacaaggtaaacaatacatagactggaaagaaatggaagataaagatttcatattttcattgtacacacgcgatttaatttctttcaaaagtaaaaacggcaagaaagtaacatgcgtagatggaacctcaaaagccgtgaatgaagagatagtatactattacggagcgaacatttcaacagcatcatttagtggaaaatcacacaacggaagtttcgaatttacatcattaggaatacaaggattagaatacttaaagaaataccaagtggatgttttaggaaatgtatcagaagtaaaaagggagaaaagaatgggctttagatga

SEQ ID NO: 5150 - RNA, 3402 nt, synthetic construct
  misc_feature 1..3402: note = Cas9 variant
  source 1..3402: mol_type = other RNA
atgggaggcttcgaagtggaccgaaaaatatccttagggctagatataggggtttcaagtgtaggatacagcgtaattgacgttgataccggaaaagtacttgaattaggaagccgcctcatcaacggaaaaataggaacagaaaaccaggcaagaagagaaatgagaggaacaagacgcctcataaaccgaaaaaaacaaagaaggaaagacacagtgaaactatttaatgagttcaaactaattgactcaaaaaaagatgaacactactttgaccactttgcaaacaacagtgacccctatgaattacgggtaaaaggtttaagtgaaaaactttcgctcagcgaaatagctgacgggttatatcatatagtaaaacggagaggcataagttacgacttaaaagacgctgacgaagaatccgaggggtcagaatatgaaaatggtctaaaaatcaacaatagcgaattaaaaaaccaaacaccggcacaaatacaactaaaacgactcaatgaatacggagcaattcgtggaaaagtagtaatagacgaagaaaaaatcctcttaaacgtcttcccaaccaaagcatatttagatgaagccaaaagaattattgaaaaacaaagagaattctatccaggcattctgactgaagaattcgaagaaaaatattgtcagatactaaccaggaaacgagactatttcgtaggtcctggctccgaaaaaagccgaacagactacggaatctacaaagaagacggtagaaccttaaacaatttattcgaagaactaataggccatgacaaaatatacccagaagaactaagagcaagcggagctagcttcacagcacagctatttaacgtattaaacgatctaaacaacctgcatatctcatcatacgaggaccaaaaattaactacagaaaataaagaacaaatcataagcgagttaaagtccactacaagtaatgtaaatatgatgaaactaatacaaaaaatcgccggatgtgaagaaagtgacatatcaggctacagaacagataaaaactataaacccgaaatctcatctatgaggatataccgaaaagtacataagaaactactagaaagtgagatcgatatcacgaattggccggacgacttcataaacaaattaagttttatattaacactcaacactgaaaatggagaaataagaaaccaactcaaaaacagattacaaccagaatatgacttcctaacagacgaacttatacaaaccataatagacaataaagaaagtttcgatataaaatcaaataataaatggcatagattctcaataaaaaccatggaactactaataccggaaatgataaaaaggccagtggaacaaatgacactaataaatgaaatgggattaataaaaaattccggaaaaaagttttcaaattacaaatacttaccttacaagaaaatagcagaagacatatataaccctgtagcgtcgaaaagcgtaagagaagcactaaaaatagtaaatgcaatcctaaaagaatatggacatatcgaatatatagtagtagagatgcctagagacaaaaacgaggatgaagcaaaagaccaaatagaaaaatttcaaaaagccaatggacgattaaaagatgcagcacttgaagaatttacagaagcaattggagacaagagcaccgtcgataaaaaactaggagtccatagatctaaattactattcaaaatacgattatggtaccaacaaagaggaatggacttatatgaagggaaaccaatatcggcagtagacctactaaacaacccagattcattccaaatagatcacataataccacagagcgtaagcttcgatgattcatttaacaacaaaacactatgtaacagcggattaaaccaaatcaaagacaaaaaaaccccgttcgaatatatgaacgaaggctatggtcaaggattcgattccatgaaagctatggtgatgaaaaatccacgaatagaccacaataaacgtaaaaattacctatttagtgaaaatgtaagcgacatcgaaactagaaaaagatttatatcccgaaacttagtagatacgagatatgcaagcagagttgtgttaaacaatttacaagaattctttaaagaaaaagaatccgacaccaaaatatcaataataagaggcaaattcacaagcaacctacgaaaacactggaaaataaataaaaacagagacacgtatcaccatcacgccatagacgccacaattatagcagcaacaccatttctaaatatctggaaaaaaggctcatcaatctttccaagcaatgtagagagtgaagacttctttgatatcaagaccgggaaaataataggaaatgacgaattcaataaatacgcatatgacgaaccctataatggattttataatgaattaagaaatgcaacagacagaataaaattcagtcaccaaatagataaaaaaatgaacaggaaggtcagcgatagcacaatatacagtacacgcgtagcaaaatcaccaaaaaataaaaaagaaagcgagtatatagtggcaaaaataaaaaatatctatgatgctgatgaatacgcaaaattcaaacgaatctacgacaaagacaaaacaaaattcttattaaacaaatatgatccaagaagttttaaccatctagaaaaaataatgaatacataccctgactcaatagaaagaacaatgtctaataataaagtaaaagtggtaagaattagtccattcgaactctatagacaagaccatggacctgtgaaaaaatatagcaaaaaaaacaacggacccgaaataaaacaactaaaatacttagataaaaaagtcggtagttcaatagacgtcacacctgataacgcaaagaataagcatgtcattcttaaatcgctcaagccatggagaacagacatctatttaaaccatgaaacaggagaatacgaaataatgggaataaaatattcagatttaaaattcaataaaggagaaggttacggaattaaaaaagcaaaatatttagagatcaaacatagagagaaagttagcgacgactcagaattcatgttcacactttacaaaaaaaacagaataaaggtagaaaacatggagaccgatgaatctgtagaaatgctattctggtcacgaacaatggatagtcagaaaggatatgcagagctcaagcctatttacaaatacaaaacagaagacgataactggccaatatacggaaacgcaaaaaaacaaataattaaaaaactaatacccaaaaactgcaaaatctggaaagtaaatacagacgtactaggaaatccattttacgtagaaaaagaaggagaatacccaaaagacgtattagactga

SEQ ID NO: 5151 - RNA, 3405 nt, synthetic construct
  misc_feature 1..3405: note = Cas9 variant
  source 1..3405: mol_type = other RNA
atgaatggcctagtactaggactagacatcggcatcgcaagcgtaggcgtagggatactcgagaaaaactcaggcaaaattgttcacgcttcatcgagaatctttcccgctgcaacagccgataacaatgtcgaaagaaggaaaaatcgacaagcacgaagacttcatcgacgaaagaaacatagaggagcaagacttaaagacctattcgaatattatggtttattaacagattttagtaaagtatctataaacttaaacccttatcgacttagagtagacggattagaccaacaacttactaatgaagaactatttatcgcacttaaaaatatcgtaaaacgcagaggaattagctacctagatgacgctagcgaagatggaggaactgtctcatcagactatggaaaagcagtagaagaaaatagaaaacttttagccgaacaaacacccggacaaatacaactcgaaagattcgaaaaatacggccaattgagaggtgatttcactgtagtagaaaacagcgaaaaatgccgtttaataaatgtattcagcacaagcgcatataagaaagaagcggagagaatactacgaaaacaacaagaatttaacaatcaaataaccgatgaatttatagaggactacttaaaaatactaacaggaaaaagaaaatactatcacggaccaggaaatgagaaaagcaggaccgactatggacgctttagaaccgatggagctacactagacaacatattcggcatacttatcggcaaatgtacattttaccctaatgaatatcgagcgtcgaaagcatcatataccgcacaagagttcaatcttctcaacgatcttaataatcttacagtcccaaccgaaaccaagaaactatccgaagaacaaaagaaaactataatagaatacgcaaaatcagcaaaaaccctcggagccagtacattactcaaatacatcgcaaaaatgatagacgcgtcggtagaccaaataagagggtatagggtcgatgtcaacaataagccggaaatgcacactttcgaagtttacagaaaaatgcaatcacttgaaaccatatcagtgggagaactatcgagaaacattctagacgaattagcccacatattaacgctaaatacagaaagagaaggtatagaagaagcaataaataccaaactgagagatagcttttcacaggatcaagtactggagctagttcagtttagaaagaacaacagctcattattcagcaaaggatggcataacttttcattgaaattaatgatggaattaataccagaactatacgaaactagcgaagaacaaatgacaatactaaccagactaggtaaacagaaaagtaaagaaacaagcaaaagaactaaatatatagatgaaaaagaagtaacagaagagatatataatcccgtagtagctaaatcagtaagacaagcaataaaaataataaacgaagcaactaagaaacatggaatatttgataatatcgtgatagagatggcaagagaaaacaacgaagaagacgccaagaaagactacataaaacgccaaaaagctaaccaagatgaaaaatatgcagcaatggaaaaagcagcatttcaatacaatggaaagaaagaattaccagataatatattccatggtcacaaagaattagctaccaaaattagactatggcatcaacaaggagaaaaatgcctatatacaggaaaatcaataccaatcagtgatctcatacacaatcaatataaatacgaaatagaccacatcctaccactatcactatctttcgacgatagcctaagcaataaagtactcgttctagctacagcaaatcaagaaaaaggacaaagaaccccctttcaagcgctagacagcatggacgacgcatggagctatcgtgagttcaaaagctacgtaaaagaaagcaaactattagggaataaaaagaaagaatacctgttaaccgaggaagatatttcaaaaatagaagtaaaacaaaaattcatcgaaagaaacttagttgacactcgctatagttccagagtagtgctaaacgcccttcaagacttctacaaaaaccataatttcgatacaactatatcagtcgtcagaggtcaatttacaagccaattaagaagaaaatggggactagaaaaatcccgagaaacctaccaccatcatgcagtagatgccttaattatcgcggctagctcacaactaagactgtggaagaaacaaaataatcctctaatcgcatacaaagaaggacagttcgttgatagtcaaacaggcgaaatcataagtctaacggacgatgaatacaaagaattagtatttaaagccccatatgatcacttcgtagatacacttagcagtaaaactttcgaagacagtatattattcagctatcaggttgattcaaaatttaacagaaaaataagtgacgctacaatctatgcaacacgaaaagcaaaactagacaaagagaagaaagaatatacctacactttaggaaaaattaaagacatatatagtctgggtacaaaaacaccctcaaaaacaggattttacaaatttttggatctatacaataaagataaaagccagttcctgatgttccaaaaagaccgtaaaacatgggacgaagtcatagagaaaattatggaacaatatagaccctttaaagaatatgacaaagccggcaaattagttgattttaacccattcgaaaaatataggcaagaaaatggaccaatccgaaaatacagcaagaaagggaacggtccggaaattaaaagtcttaaatactacgatatactactcggaaaacataaaaacattactcccgagggatctaggaatacagttgcattactatcactaaatccatggcgtacagacgtatactataacatggaaacaaagaaatatgagttcttagggctaaaatacgcagaccttccttttgaagaagggggtgcatacggaatatccacagaaacctataatgaattacgagaaaaagaagggataggtaaaaactcggagttcaaattcacgctatataaaaacgacctaatactaataaaagatactgaaacaaactgccaacaattctttaggttttggtcaaggactggcaaagacaacccaaagagcttcgaaaaacacaaaatagaactaaaaccatatgaaaaggcaaaatttgaaaaaggagaagaacttgaagttctaggcaaggtaccacccagctctaatcaatttcagaaaaatatgcaaatcgaaaacttatctatttataaagtgaaaacagatgtattaggaaacaagcatttcataaagaaagaaggagataaaccgaaactaaaattctga

SEQ ID NO: 5152 - RNA, 3405 nt, synthetic construct
  misc_feature 1..3405: note = Cas9 variant
  source 1..3405: mol_type = other RNA
atgaatggcttagtattaggcctcgacataggaatagcgtctgtcggagttggaatcctagagaaaaactccgggaaaataattcacgcaaactcacggctattcccagccgcaaccgctgacaataatgtagaaagaagaaagaatcgccaagctcgaagactcaacagacgaaagaaacaccgaggcgtacgattccaagacctattcgaagactatggactactaacagatttcagtaaagtcagcattaacttgaatccgtatagattacgagtagacggactaaaccaacaactaacaaatgaagaattattcattgcccttaaaaatatagtaaaacgccgtggaatatcatatttagacgacgccagcgaagacggtggagcagtaagttccgactacggtaaagccgttgaagaaaatagaaaactcctagcagaacaaacgccaggccagattcagctagaaagattcgaaaaatatggacaagtaagaggagatttcacggtagttgaaaacggcgaaaaactacgactaataaatgtcttctcaacatctgcatataagaaagaagcagaaaggatccttcgaaaacaacaagagttcaataaccaaataacagacgagttcatcgaagattacttaaaaattctaaccggaaaaagaaaatactatcacggacctggaaatgagaaaagcagaacagactacggaaggtttagaacagatggaactacactagataacatatttggtatactaataggtaaatgtaccttctaccccgaagaataccgagcaagtaaagcatcatacacagcgcaagagttcaaccttctaaacgacctaaacaatttaaccgtaccaaccgaaacaaagaaacttagtgaagaacaaaagaaagtcattgtagaatacgcaaaagaagccaaaaccctaggagcatccacgttactaaaatacattgctaaaatgatagatgcatcagttgaccaaattagaggatacagagtagacgtaaataacaaaccggaaatgcacaccttcgaagtatatagaaaaatgcagagcttagaaactatctcggtcggcgaattatcaagaaatgtattagacgaattagcacacatactaacattgaacaccgaacgagaaggaatggaggaagcaataaacacaaaactaaaagattcttttagccaagatcaggtactagagttggtccaattccgcaaaaacaactccagcctcttctcaaaagggtggcataatttcagcctaaaattaatgatggaactcatcccagaactctacgaaacttcagaagaacaaatgacaattctcacccgattaggtaaacaaaaatctaaagaaacatcaaaacgaaccaaatacatagacgaaaaagaactaactgaagagatttataatccagtggtagcgaaaagcgtcagacaagcaataaaaataataaatgaagcaacgaagaaacatggaatattcgacaacatagttatagaaatggcacgagaaaacaacgaagaagacgccaagaaagactacattaaacgacaaaaagcaaaccaagacgagaaaaatgctgcaatggaaaaagctgccttccagtacaacggcaagaaagaactacccgacaacatattccacggacacaaagaactagccacaaaaatacgactatggcatcaacaaggagaaaaatgcctatacacaggaaaaacgatacccattagtgatctaattcataatcaatacaaatacgaaatagaccatatcctacccctatcactatcatttgatgattctttatcaaataaagtactggtactggcgacagctaaccaagaaaaaggacaacgaacaccctttcaggcactcgattcaatggacgacgcatggtcttatagagaatttaaaagctacgtcaaagaaagtaaattattaggaaacaaaaagaaagaatacttactaactgaagaagatatatccaaaatagaagtaaaacagaaattcatagaacgtaacctcatagatacacgatactcatccagagtagtactaaacgccttacaagacttctataaagcccacaaatttgacactactatctcagttgtacgaggccagttcacgtcacaactacggagaaaatggggtttagagaaaagcagagaaacctatcaccatcacgcagtcgacgcactaattatagctgcgtcatcacaactacgactctggaagaaacaaaacaacagtttaatatcctacaaagaaggtcaattcgtggacagcgaaacaggtgaaattatctcattaacagacgacgaatacaaagaacttgtattcaaagcaccctacgatcatttcgtcgacacgctacgctcaaagaaattcgaagactcaatcctattctcttaccaagtagattcaaaattcaaccgcaaaatatcagacgcaacaatatacgccactagaaaagccaaattagacaaagaaaagaaagaatatacatatacactaggtaaaattaaagacatatattcattagggacgaaagctccatccaaaacaggtttttacaaattcttagacctatacaacaaagataaatcacaatttttaatgtttcagaaagacagaaaaacatgggatgaagtaatagagaaaataatggaacaatatagaccattcaaagaatatgataaaacaggaaaactggtagactttaatccatttgaaaaatacagacaagaaaatggaccaatcaggaaatactccaagaaagggaatggaccagaaataaaaagtctaaaatactacgacatactactaggaaaacataaaaatataacaccagaaggaagtcgaaatacggtggctctactatccctaaacccctggagaactgacgtgtattacaacatggaaacgaagaaatatgaatttctcggactcaaatacgcagacctaccatttgaagaaggtggtgcatatggaatatcaacagaaacttataatgaattaagagaaaaagaaggaatagggaaaaacagcgagttcaaattcacattatacaaaaatgatttaatcttaataaaagacactgaaaccaattgtcaacagatatttagattttggagccgaaccgggaaagataacccaaaatcgtttgaaaaacacaaaatagaattaaaaccatacgaaaaagcaagatttgaaaaaggagaagaacttaaagtgctaggcaaagttcccccaagcagtaatcaactacagaaaaatatgcaaatcgaaaacttaagtatatataaagtaaaaactgacgtcttaggaaacaaacacttcattaagaaagaaggtgatgaaccaaaacttaaattctga

SEQ ID NO: 5153 - RNA, 3405 nt, synthetic construct
  misc_feature 1..3405: note = Cas9 variant
  source 1..3405: mol_type = other RNA
atgaacggcctagtattaggactagatatcggaatagcaagtgtaggagtaggaatactagagaaaaactctggaaaaataatacatgaaaacagtagattattccccgctgccacagcggataataatgtagaaagaagaaagaacagacaagcacgaagactaaacagacgtaagaaacatcgcggagtcagatttcaagacctgtttgaagactatggactcttaacagacttcagcaaagtatcaataaatttaaacccataccgactacgggtagacgggcttaatcaacaactaacaaatgaagaactgttcatagccctaaagaatattgttaaacgaagaggaataagttacctagatgatgcttcggaagatggaggcacagtaccatcagattatggaaaagcagtaaaagaaaacagaaaattattagccgagaaaacacccggccaaatacaactagaaagattcgagaaatacggtcaactacgaggtgacttcacggtagaagaaaacggagaaaaatgtcgtctcattaacgtatttagcacctcagcctacaagaaagaagccgaaagaatcttacgaaaacagcaagagttcaacaatcaaataacaaacgaatttatagaagactacttgaaaatactcacaggaaaaagaaaatattaccacggtccaggtaacgaaaaatctcgaaccgattatggaagatttagaaccgatggcacaacactggataatatcttcggcattcttataggaaaatgtacattctaccccgaggaatatagagtaagcaaagcgtcatatactgcacaagagttcaatatcctaaatgatctcaacaacctaacggtcccaactgaaacaaagaaactaagtgaagaacagaagaaagatatagtcgaatatgctaaagaaacaaaaacactcggagcaagcaccttattaaaatacatcgcaaaaatgatcgacgcatcagtagaccaaatcagaggatatcgagtagacgtaaacaataaacccgagatgcatacgtttgaagtataccgcaaaatgcaaagtctagaaacaattagcgtcggagagttatcaaggaacgtactagacgagcttgcacatatactcacactaaataccgaaagagaaggaatagaagaagctataaacaccaaactaatgggagtcttctcacaagaccaagtcttagaattagtgcaattcaggaaaaacaatagtagccttttctcaaaaggatggcacaacttctctttgaaactcatgatggaattaataccagaactatatgaaacaagtgaagaacaaatgacaatactaaccagactaggaaaacaaaaatccaaggaaactagcaaaagaactaaatacatagacgagaaggaagttacagaggaaatatataatcctgttgtagcaaaatctgtaagacaagcaattaaaataataaacgaagccaccaagaaatatggtatctttgataacatcgtgatagaaatggcaagggaaaacaatgaagaagacgcaaagaaagactacataaaaagacaaaaagcaaaccaagatgagaaaaatgcagcaatggaaaaagcagctttccaatataacggcaaaaaggaattacctgattcgatattccatggacacaaagaactggcaaccaaaatacgcttatggcatcaacaaggagaaaaatgtttatacacaggcaaaaacataccaatatcagacctgatacacaatcaatacaaatatgaaatcgaccacatactaccgctatcccttagttttgacgactccctatccaacaaggtcttagtactagcgacagccaaccaagaaaaaggacaaaggacaccatttcaagcacttgacagcatggacgatgcttggagctaccgcgagttcaaaagctatgtcaaagactcaaaactcctttcaaacaaaaagaaagactacctgctaacagaagaagatatttcgaaaatagaagtaaaacaaaaattcattgaaagaaatttagtcgacacacgatactcatcaagagtagtactaaacgcactgcaagatttctataaagcacacaaatttgatactacaatttcagtagtaagaggacagttcacaagtcaactaagacggaaatggggattggaaaaatcgcgtgaaacgtatcatcaccatgccgtcgacgcattaattatcgcggccagcagccaattaagattgtggaagaaacaaaataatcccctaataacatataaagaaggacaattcgtagatagcgaaactggcgaaatcatcagcctaacagatgacgaatacaaagaattagttttcaaagcaccatacgatcactttgtagacacgctaaggtcaaaaactttcgaagactctatattattctcataccaagtcgactcaaaattcaacagaaaaatttcagatgcaacaatatacgcgaccagaaaagccaaactggacaaagaaaagaaagagtatacgtacacacttggcaaaataaaagacatctatagcctaggtactaaaacacccagcaaaacaggattttataaatttctcgacctatacaacaaagacaaatcacaattcctaatgtttcaaaaagacagaaaaacgtgggacgaagtaatagagaaaataatggaacaatacagaccctttaaagaatatgataaaacaggaaaactggttgactttaatccattcgaaaaataccgacaagaaaacggaccaatatgtaaatattcaaagaaaggaaacggaccagaaataaaatcactaaaatattatgacatactactaggcaaacacaaaaatatcaccccagaaggctcaagaaacacagtcgccttactctcactcaatccctggagaacggatgtgtactataacatggaaactaagaaatatgaatttttaggactaaaatatgcagatctacctttcgaaaaaggaggagcctatggcatatcaaccgaaacctacaataaactgagagaaaaagaaggaatagggaaaaacagtgagttcaaattcacactgtataaaaatgatctaatactaatcaaagacacagaaaccaactgccaacaaatatttagattctggtcacgaacagggaaagataatccaaaatcatttgaaaaacacaaaattgaattaaaaccatacgaaaaagcccgattcgaaaaaggagaagaactagaagtcttgggcaaggtcccaccaagtagcaatcaatttcagaaaaacatgcaaatagaaaacctaagcatatataaggtaaagacagacgtgctaggaaagaaacatataataaagaaagaaggagacgaaccaaaattaaaattctga

SEQ ID NO: 5154 - RNA, 3405 nt, synthetic construct
  misc_feature 1..3405: note = Cas9 variant
  source 1..3405: mol_type = other RNA
atgaagtacatcgaatcagtaagtatcggatttgacataggagtcggaagcgtaggatacgcagtgatcaattcaaaaacaaaacaaatactcgaaagcggggtttccatatttcccgctgccgtcgcacaaaaaaacgtcgaaaggagagaatctagacaaagtcgacgactacgacgccgaagagttaacagactaaacgacttaaagaaactactaaaaaaaaacggatttatccccagcccaaataaaaacccatacgaaattagagtacgaggattagagcaccaactatcaagagacgaaatagctatagcagttttacacatagcaaaacgaagaggcatatcatacagcctagacgatgtagtagacgaaaacgtcacagatttcaaaggtaaaatcgctaaaaaccaagaggcattaaaaaataagactcccggagaaatacaatacgaacgacttctcaaatacggcaaagtaagaggcacagttacaaactacgtagaatatgacgaacaaccagaatactttctgaatgtattcccaaactccgcctatgtagatgaagcaaaaagaatactcacttgccaaaaacaatattaccccgagatcacagacgatctaatagaaaatatagtcaaaattatatctagaaagagagcatactatatcggaccaggaaacgaaaaatcaagaacagattacggaatttaccgaacaaatggagaaacactagaaaatatctttgaaattcttatagggaaagactcggttaaccctgacgaattaagagcaccagctaactccctaacagcacaagtatacaacttacttaacgacttaacaaacatacgatacaatggatcagaaaggctaactccagaacaaaaacaagatattctttctgagcttttaacaactgaaaaaacagttcaaatgctaaatgtaatcgcaaaaaaagtaaatgtgaaaaaagaagaaataagcggtttcagaacaaaaaaagatgataaaccagatttccacacactcgaagtatatagaaaagttcgcaaacatatgctcaacaaagggatcgatataaatgagtggccaactgaatgcttcgacgaactagcatttatcttcaatttaaatacagaaataggggaaataagaaatagaatatccgagaaagttgtgcccaaatacgactttataacaaatcaaatagtggatgatttactagaagaccccaaaatttttgccataagtacatcacaaaaatggcacagattctctattaaaacaatgaatgtactaatcccagaactcttaaacgggtataatgaacaaatgactatcttaacgagaatgggactcttggaagattctaaaaacgactacagtaatatagacaagatagacataaaaaacgtcacagaaaatatttacaatcctgtagtaagaaaatcaatcaaaaaatgcttaaagatttttaatgaactatacaaaaaataccccaatatatcagacgtagtcatagaactacccagagaagataacccagaagacgcaagaaaactaataaaaaaaatgcaaaaagaaaatctggtagaaaaagatacttcactagaagcattccgcaaagaggcaaatctctcggaaaacggattaatagattttttaagaaaaggtaaaaaccgagctttaaaaatcaggttatggtaccagcaagaaggcaaatgtctatacactggagaaccaatactagccgaggacctttgcaaaaacgaggcaaattacgacatagaccatattatacccatctcagtctcattcgacgactcaatcaataacaaagtactctgcagtagtcactttaatagattcgaaaaagaaaaaaaaacaccgttcgaatacttctcgaacaaatcatcccacttaggtagatactctaattttgacgaatttcgagcatcggttaacgctaataaacgaatatcagatgtcaaacgaaaaaatctgctatcaaaagaattattaagtgatctcgacacacgcaaaaaattcatagcgcgaaacttagtagatactagatacgcatcgagagtagtgtttaacgaactcacacaattttttgcaagtaaaaaagccgacactaaggttgcagtaattagaggaaaatttacctcgcaactacgacgagcttggcaactaaacaaatctagagatacatatcaccatcacgcagtagatgctgcattaattggggtaacaccctttcttaaaatatggagatcaggtaaaaccatttacccaagaaaaatgacagaagcccagacagactttgaactcaacgaaatcacaacaaacgacgaatttaaagaaagctactaccaattaccttgtccacaatttctggattaccttacccaaatgcaagaaaacttaaagataaactttgaagttgacaaaaaaatgaaccgtaaaatctccgatgctatgatttattcatcacgaaaaaaaaaactatcaaaagacaagaaagaaaaagaatactcactcggaacaattaatgacatttattccgatgcaggatatagcaaatttaaaaatatatacaaaaaagataaagaaaaattcctaatgtatcacctagaccataaatcattcgaaatcctagaagatataatatcccaataccctgataaagaggaatacatcgactcggaaggcaaagtaaaacaaagggcagtttcaccattcgaaatctacaggcgaaaatatggttacatacgtaagtactctaaaaaaaacaacggacccatcatcaaaaacatgaaatactataatgaaaacctaccaaaaatatacattgatataaccccgaaacaatcgatagacaaaaaagtttatcttacaaatatatcgccatggagaactgatgtttactataaccgaagtcaaaattcataccatataatgggaattaaatatagcgatttgagatacatcgacgggaaatatggaatacctaaaaacgtttacgagaaaatcaaactaagagaaaaaataccttcagaatcagaattttgcttctcgctctataaaaatgatagagtaaaaataatagatcccaataaaaatgaggaaatagaactaagattcaattcacgcacactaccaagcgtactaaattatgtcgaatttaaaccattattccaagaaagctataactctctaacgctactaccagtattctcaaaaacaacgagcgaaggacgcataattaaaaaattcacgcgagaagacaatattgtatacaaagtaaatacagacgaactagggaacccatactacatacttaaagaatcacaaaacccaaaaaacataatcgataactcaaacaaaaccgaatga

SEQ ID NO: 5155 - RNA, 3405 nt, synthetic construct
  misc_feature 1..3405: note = Cas9 variant
  source 1..3405: mol_type = other RNA
atgaatggacttgtactgggcttagacatcggaatagcctcagaaggagtcggaatattagagaaaaattcaggtaaaatcatacatgcaaacagtagactattcccagcagctacagccgacaacaatgtagaaagaagaaagaacagacaagccagaagattaaatagacgaaagaaacacagaggagtaagattccaagatctgtttgaagactacggtctactaacagacttctcaaaagtatccatcaatctaaatccttatcgcttacgagttgatggattgaaccaacaattaaccaacgaagaactatttatagcattgaaaaatattgtaaagagaagaggaataagctatttagacgacgcaagcgaagacggaggagcagtatcgtctgactatggaaaagccgtagaagaaaacagaaaactactagcagaacaaactcccggtcaaatccaattggaacgtttcgaaaaatacggacaagtcagaggagacttcacagtagtcgaaaatggcgaaaaattacgcttaatcaatgttttcagcacatcagcttacaagaaagaagcagaacgcatcctacggaaacaacaagagttcaacaatcagattacagatgagttcatagaagactacctgaaaatactaacaggcaaaagaaaatattaccacggacccggaaatgagaaaagcagaacagactatggaagattccgaacagacggaacaacattggacaacatatttggcatcctaataggtaaatgtacgttttacccagaagaatatagagctagcaaagcatcttacacagcacaagagttcaacttattaaacgatctaaacaaccttacagtcccaacggaaacaaagaaactaagcgaagaacaaaagaaagtcatagtagaatacgcaaaagaagcaaaaaccttaggcgctagcacattactaaaatatatagcgaaaatgatagatgcaagtgtcgatcaaataagaggatatcgggtcgatgtaaacaacaaacccgaaatgcacacatttgaagtttatagaaaaatgcaaagtctagaaactatttcagtcggagaactttcaagaaacgtactagacgaactagcacacatactaacacttaacacagaaagggaaggtatggaagaagcaataaatacgaaattaaaagacagcttttcccaagatcaggtcttagaacttgtacaatttaggaaaaataattcaagcctattttcgaaaggatggcacaacttttcattaaaacttatgatggaactcattccggaactctacgaaacctcagaagaacaaatgacgatactaacacgcctcggaaaacaaaaatcaaaagaaacaagtaaacgaactaaatatatagatgaaaaagaattaacagaagaaatatacaatcccgttgttgcaaaatcagttcgacaggcaataaagatcattaatgaagccacaaagaagcatggaatattcgacaacattgtaatagaaatggctcgagaaaacaacgaagaagatgccaagaaagattatataaaaagacaaaaagccaaccaagatgagaaaaatgcagcaatggaaaaagcagcatttcaatacaacggcaagaaagaattgcccgacaacatatttcacggacacaaagaacttgcaaccaaaatcagactatggcaccaacaaggtgaaaaatgtttgtacacgggaaaaacaataccaattagcgacttaatctataatcaatacaaatacgaaatcgaccacatcttaccactaagcctcagtttcgacgactcactaagtaataaagtcctagcattagctaccgctaatcaagaaaaaggccaacgaactccattccaagcactcgattcaatggacgacgcatggagttatagagaatttaaatcatacgtcaaagaccttaagtcattaagcaacaagaagaaagactatctcctaaccgaagaagatatatcaaaaatagaagtgaaacaaaaattcatagaacgaaacttagtagacactagatacagcagcagagttgtgttaaatgctctacaagacttctataaatcccaccaatttgataccacaataagcgttgtaaggggacaatttacatcacaattacgccgaaaatggggacttgaaaaatcaagagaaacttatcaccatcatgctgtagacgcattaataatcgcagcaagctcccaactcagattgtggaagaaacaaaataacccactgattacatataaagaaggacaatttgtcgacagccagactggtgaaatcatctctcttaccgatgacgaatacaaagagctagtatttaaagccccatacgaccacttcgttgacactctatccagtaaaacgttcgaagactcaatattattttcataccaagtagatagcaaattcaacaggaaaatcagtgatgcaaccatatacgctacaagaaaagcaaaattagacaaagaaaagaaagaatatacatacacgttaggcaaaataaaagacatatatagtctgggtaccaaaacaccaagtaaaacaggcttttacaaatttctcgacctatacaacaaagacaaatcgcaattcctaatgtttcaaaaagaccgcaaaacatgggatgaagtaatcgagaaaatcatggaacaatacagacctttcaaagaatacgacaaaacaggtaagttagtcgactttaacccattcgaaaaataccgccaagaaaatgaaccgataagaaaatactcaaagaaaggtaacggccctgaaatcaaaagcctaaaatattacgacatacttctaggcaaacacaaaaatataacacccgaaggctcacgaaacacagtagcattactaagtttaaatccatggaggacggacgtatactacaatatggaaaccaagaaatacgagttcttaggcctcaaatacgcagacctaccatttgaagaaggaggtgcatacggaatatcaacagaaacatacaatgaattaagagaaaaagaaggaatcggcaaaaattctgagtttaaattcacattatacaaaaatgacctaatattaattaaagacactgaaactaattgccaacaaattttcagattctggagtcgaacaggaaaagataatcctaaaagttttgaaaaacacaaaatcgaactcaaaccgtacgaaaaagcacgattcgaaaaaggagaggaactagaagtactaggaaaagtaccgccaagctccaaccaactccagaaaaatatgcaaatagaaaacctatccatctacaaagtcaagacagatgtactcggtaataaacattttataaagaaagagggagataaaccgaaattaaaattctga

SEQ ID NO: 5156 - RNA, 3408 nt, synthetic construct
  misc_feature 1..3408: note = Cas9 variant
  source 1..3408: mol_type = other RNA
atgagcgatctagtccttggtctagacataggtataggctcagtaggtgtaggaattttaaataaagtaaccggcgaaataatacataaaaattcaaggatatttccagcagcacaagctgaaaataatttggaaagaagaaccaaccgacaagggagaagactaacaagaagaaagaaacatcggagggtacgactaaaccacttatttgaagaatcaggactcatcacggatttcacaaaagtaagcataaacctgaacccgtaccaactgagagtcaaaggactcacagcagaactttcaaatgaagaattattcatagcactcaaaaacatggtaaaacaccgtggtatatcatacttagatgatgcatcagacgatggcaacagcagtgtcggtgattatgcccaaatagtgaaagaaaactctaaacaactagaaactaaaacacctggacaaatccaactggaaaggtaccaaaaatacggccaattacgcggagacttcacagtcgaggaagatggccgcaaacacagactaatcaacgtttttccaacaagcgcctaccacgccgaagcgcttcgcatattacaaacacaacaagagttcaatccccaaataaccgatgaatttattaattcctacttagaaattctaacaggtaaaagaaaatattaccacggaccaggcaacgaaaaatcacgaacagattatggaaaatacaccactaaaaaggatgcacaaggacaatacataaccctaaataacatattcgggatcttaataggtaaatgtacattttatccagaagaatacagagcggccaaagctagctatacagcccaagaatttaatctattaaatgatctaaacaacttgacagtacccaccgaaaccaagaaactcagtgaagaacaaaaatatcaaataataacatacgtgaaaaatgaaaaagccatgggtccagcaaaacttttcaaatatatagcaaaactattggcctgtgacatagctgatatcaaaggatacagaatagacaaatccgacaaagcggaaattcatacattcgaagcctataggaaaatgaaaacactagaaactatagatatagaacaaatagaaagagaaaagctagataagttagcatatgtactgacacttaatactgaaagagaaggcattcaagaagcactcgaccatgagttcgcagatggaacattttcacaagaacaagtagatgaattagtacaatttagaaaagctaatagctcaatattcggaaaaggatggcatagcttttcagtcaaacttatgatggaactaataccagaactatacgccacttctgaagaacaaatgacaatcttaactcgactggggaaacaaaagacaacatcatctagcaacaaaactaaatacatcgacgaaaaacaacttactgaagaaatatacaatcccgtagtcgcaaaatcagtaagacaagctatcaaaatagtaaatgcggcaatcaagaaatacggcgatttcgacaacatcgtaatcgaaatggccagagaaacaaacgaagatgatgaaaagaaagctatacagaaaatacaaaaagccaacaaagccgaaaaagacgcagccatgaggaaagcagcgaaccaatataatggaaaagcagaactaccccatagtgtattccatggtcacaaacaactggcaacaaaaatacgactatggcaccaacaaggagaacgttgcttatataccggcaaaactatatccatacatgatctaataaataaccccaaccaatttgagatcgaccatattctaccgctaagtatcacattcgacgactccttagccaacaaagtactcgtttacgcaaccgctaaccaagaaaaaggacaaagaaccccatatcaggctttagattcaatggacgacgcttggtcattccgagaactaaaagcatttgtccgcgaatctaaagcactaagcaacaaaaagaaagagtacctattaaccgaggaagatatctctaaattcgacgtaaggaagaaattcattgaaagaaaccttgtggacactagatatgcatcccgtgtagtactaaatgctctacaagaacacttcaaagcacacaaaattgacaccaaagtatcagtagtacgaggacaattcacatcacaactcagaagacattggggaatagacaaaactagagatacctatcatcaccacgcggtcgacgcactaattatcgcagcctcaagtcaactaaacctttggaagaaacagaaaaacactctagtttcctattctgaagaccaacttcttgatatcgaaacaggtgaactcatatcagacgacgaatacaaagaatcagtttttaaagcaccctaccaacatttcgttgacacattaaaaagcaaagaatttgaagacagtatacttttctcttatcaagtagactccaaatttaaccgtaaaatatccgacgcaacaatttatgcaacaagacaagccaaagtaggaaaagataagaaagatgaaacatacgtattaggtaaaataaaagacatatacgctttaggaacaaaaactccctcaaaaacaggattttataaattccttgatctctataacaaagataaaagtcaattcttagtctaccaaaaagatcgcaaaacgtgggacgaggtaatagagaaaataatggaacaatacagaccattcaaagaaagtgataaaaatggaaaagaagtcgatttcaaccccttcgaaaaatatcgaatcgaaaatggacctataagaaaatattccagaaaaggaaatggtcctgaaataaaatcactaaaatattatgcctccaaacttggaaaccacatagacattacaccaaaagactcaaacaacaaagttgtcctacaatccgtcagtccatggcgcgctgatgtatattttaataaaacaaccggcagctatgaaatactaggcttaaaatacgcggatttacaattcgaaaaaggaacaggaacatatagaataagtgaagaaaaatacaacgatattaaaaagaaagaaggagtcgattcagacagtgagtttaaatttactctatacaaaaacgacctactccttataaaggatactgaaacaaaagagcaaagactatttcgcttcctaagtcgaagtatgccaaacaagaaacactatgtagaactaaaaccatactccaaagacaaattcgagaaaaacgaatccttaatagaaatactcggatctgcagacaaaagcggaagatgtatcaaaggtcttgctaaatccaacctttcaatctttaaagtcagaacagatgtattaggcaatcaacatataattaaaaacgaaggcgacaaaccgaaattagatttctga

SEQ ID NO: 5157 - RNA, 3408 nt, synthetic construct
  misc_feature 1..3408: note = Cas9 variant
  source 1..3408: mol_type = other RNA
atgggagtaatatttttgtacgaaaacattgttaaaccctttccatcacgatacgacaaggccatcatgaaaagattaaaaggaagacaaacaatggggtatatactttctttggatattggaatagcctcttgcgggtacagtgtcctagagacagatgctttaggagtaccatataaaataaaaacactgaatagcataatcttcacacgagcagaaaatcctaaaacaggcgccagtttggctgaacccagaagaaaatatcgtggggcaagaagaagaaaacgaagaacaagtttccgaaaacacaggactagacaattattcataacatccggtttgttatccaaacaagacatagcaagatacctaaatcaacaagaacctcacgacgatatatgggaattaagagtaaaaggattagatgaaccactcaccaacctacaactattccaagtattatactactttgtcacacacagaggattcaaatcaaacagaaaagcagaactaaaagataaagatataggacccgtactaaatagtataaacgcattcaaagaagaaatgcaatcacacgactatagaacaataggcgaactatacgccaatgatccaagatttcgtgatcgaaaacataataaagattatacaaacggctttctaggaacgatacaaagatcatggttagtggatgaaattaaaatgttattaacgaatcaacaatcatttggtaacactcagctaacaagcgagttcatagaattatacttaaacatattcacttctcaaagaaattttgatgatggacctgcctcaggtccatactcaggagatttaatcgataaaatggtaggaccggacaccttcaatagaagcagaaaacgcgccccaagagcgacatatacgttccaatatttttcgtttctaagtaaattaaatagcttacgaatagcaccatctatttcagcaccatttgaaactctcacagttgaccagcgcgctctaataacaaaacgcctatggggtccagacgttaaatccgcagatttaaaattcaaacaaattaggatggtgttaagcctacctgaaacagcaagatttaatcttgtaaattacggaaatacacccgaaaaagccctagaaatcgaggacaaaaccactttcatttcgattaaaccactcagagaaatagaaaaagcactaacaggaacaacactaccagtctcacacgatcaactcgacgcaatagcaagaatattaaccgtatataaatcagattctaacagaaaaaccgcatttcacaaccaaactgtattgtcagacgaagttatcgaacaactgctccctcttaatttctcaaagttcggccacctctccgttgaaacgatgcaagagatcattccatacttagaacaaggcatggtatattctgatgctgctactgccgctggatacgactttagaaacaatcaaatagacatggaatatatcagagataacgtcactaatccagtcgttaggagagccgttagcgtagcaaataaactcgtaaaagctgtagtgagacgatacggtaaacctgattcaatacacatagaactcgctagagacctatcccaaaacttccaagaaagacgccaagacgaagttcgacaacagaaaaatgctagggacaatgagaaaatagcaaaaagactcgaggaacttggaatacccgtaaatggagtaaatatcactaaaatgaaactatacgacgaacaacatggtatagacctgtatgacctttctacgaacgcatcaatggcagtcacagatatatttagtgacgatagatacgaaatagaccatataataccctactcagtcagttttgacgattcttatacaaacaaagtcttagtatcagcaaaagcaaatagagagaaaagagaccgaataccaatggaagtattcggaaatgattcagaaagaaggagacaatttgaaaatcgagttaacacaaacataaccaacctaaggaagaaaagaaacttactaaaagaaacgtttagcgacgaagataaagctaaatggaaaagtcggaatataaacgatacacggtacttaaatagaatactaatgaactacttatcccaaaatgtagaatttacggacgtgctatctgatgctaaacacgtaatcgctcttaatggagcagtaaccgcaaaaataagaagtagatggggaataacaaaagtaagagcagctggcgatctacatcacgcagttgacgcagtcgtaatcggctgcgtaacggacgcgttaatacaagccgtaactcgatatgcaaaataccaagagagaagagataataaagcagcagctgaacaggatctggcagagaacaatccagaagaactcgacgccaaacaatttagaaaggtatttaatgattaccctctaccgtggccagagttccgggaagaattaatgggtcgcgtatctagtgacccatcgcaaataatggcaggtcgacagtggtcacactatacagcagaggaaatcagtgaattgaaacaaccattcgttgtaagggtaccgaatcatcgaatagtaggcccagcaacattagacacagtatatggacagcccaatccagacgatggcctaataacacaaagagtaaggataaccgacttaaaaccccagaaaaacaaagacggtgaagacataataaaagcaggagctaatgtttacgaactagcggccgatggtggcaataaacttgtatatgaaagtatcttagacgcactgcaagtagcgggaggagatggtaagaaagcatttccaacaggcagacttctagttagatcgccaattcaagatattccagtagaaagagtaagagttacttcgaaagcgactctagtcgttcccgtaggcccaaaaagtgtcgcggcaaatggttcgatggtcagaatagatgtctataaaactcctaagaaatatgtattcgttccaatatatgtgagagacacagtaaaagcagaattacccgatagggccgtagcacctgtcaaaccgtatagtcaatggtaccaattacaaccaaaagaccaattcttattctcgctatttgctaatgacttaataagatttaaacacccaagaggagttagtacaaaagaaattctaactgacggttcacaagaaaagggaaaaagaacagatgtagtgggatattttacaggagccgatatagcaacagcgagtatagcaatagagggaccagaccgttctttttcagcgcgtggaattggatttgcaagtttaaagaacgtggaaaaacttactgtaaactacttcggagagcttcattcagtgcacgaaacacaaccaatgcaattcagaggacaaagaggatga

SEQ ID NO: 5158 - RNA, 3411 nt, synthetic construct
  misc_feature 1..3411: note = Cas9 variant
  source 1..3411: mol_type = other RNA
atgaacggcctagtactgggattagacataggaatagctagcgttggagtaggtatacttgaaaaagatactggcaaaataatacatgcttcatcaagactattcccagctgcaacagcagacaataacgtagaaagaagaagtaacagacaaggcagaagattaaataggagaaagaaacacagaagcgtacgcttacaagacctatttgaatcatacggattattaactgatttctcgaaattatcgattaatctaaacccctatcaacttagagtacaaggaatggaaaatcaattaacaaatgaagaactatttatagcactcaaaaacatagtcaaacgacgaggtatttcgtatttagacgacgcctccgaagacgggggtacagtttccagcgactacggtaaagcagtagaagaaaacagacgactactaacagagaaaaccccaggccaaatacaactagaaagattcgaaaaatatggacagttaagaggtgatttcaccgtagaagaaaacggagaaaaacgaagattaattaacgtgttttcaacttcggcataccgaaaagaagctgaaagaatactacgaaaacaacaagagttcaacaacaaaataacggatgagttcatcgaagactatctaaccatcttaaccggcaaaaggaaatactatcacggaccggggaatgaaaaatctagaacagattatggcagatttagaactgatggcactacactggacaacatatttggcatattaattggaaaatgcaccttctatcctgaagaatacagagcctccaaagcgtcttatacagcacaagaatttaatttactaaacgaccttaataacctaacagtaccaaccgaaaccaagaaattaagtgaagaacagaagaaaactataattgaatacgcgaaatcagcaaaaactttaggcgcttcgacattactaaaatacatagctaagatgatagacgcaagcgtagatcaaatacgaggataccgagtagacgtaaataacaaaccagaaatgcacacgtttgaagtataccgaaaaatgcaatcactagaaactatcaaagtagaagaattaccgcgaaaagtattagacgaactagcccatatactgacactaaacacagaaagagaaggtatagaagaagccattaacagtaaattaaaagatacattcaaccgtgatcaagtactggaacttgtacaattcaggaaaaataacagttcactatttagcaaaggttggcacaatttttcgttaaaactaatgatggaactcattcctgaattatatgaaacgagcgaagaacaaatgacaattttaacgagattaggaaaacaaagatccaaagaaacaagtaaaagaacaaaatacatagatgaaaaagaactgacagaagaaatatataatcccgtcgtcgcgaaatcagttagacaagcaataaaaatcataaatgaagcgacaaagaaatatggaatcttcgacaatattgtcatcgaaatggcaagagaaaacaatgaagaagatgccaaaaagaattatattaaacagcaaaaagcaaatcaagatgagaaaaacgccgcaatggaaaaagcggcatttcaatataacggtaagaaagaacttccagacaatatattccatgggcatatggaactggcaacaaaaataagattatggcatcaacaaggggaaaaatgcctatatacaggcaaaaacatacaaatcagcgaccttatacataaccaatacaaatacgaaatagatcatatacttcccctcagcttaagtttcgatgacagtttatcaaacaaagttttagtcttagccacagctaaccaagaaaaagggcaaaggacaccatttcaagcactcgatagcatggatgacgcctggtcatacagagagttcaaatcatacgtaaaagaaagtaaattacttggcaacaagaagaaagattatctcctaactgaagaagatataagcaaaatagaagtcaaacaaaaatttattgagaaaaacctggtggatacaagatacagcagcagagtagtcttaaatgcgttacaagacttttataagaaacatcagttcgatacgacaatatccgtcgtaagaggacaattcacgtcccaactaagaagaaaatggaaactcgagaaaagtagagatacataccatcatcacgcagtagacgcactaattatagcagcaagtagccaactacgcctatggaagaaacataacaatcccttgatctcgtacaaagacggacaatttgtagatagtgaaacaggagaaatagtatcattaagcaatgaagaatataaagaattagtttttaaagctccatatgaccacttcgtagatacactaagaagcaagaaatttgaagactcaatactgttctcatatcaagttgacagcaaatacaacagaaaaatcagtgacgcaacaatatacgctacaagaaaagccaaactagacaaagataagaaagaatacacttatacactaggtaaaatcaaagatatctacgcattaggaacaaaaaccccttcaaaaacaggcttctataaattcctagatctatacaaaacagacaaaagccaatttcttatgtatcaaaaagatagaaaaacatgggacgaagttattgagaaaataatcgaacaatatcgcccgtttaaggaatacgataaaaacggcaaagaagttgactttaacccctttgaaaaatacagaatagagaacggacctataagaaaatattcccgaaaaggaaacggaagtgtaataaaatccatgaaatattatgacaacctactcggtaaattcgtagacattactccatcggaaagcaaaaaccccgtggcacttttatcattaaatccatggaggacagatgtatactataatccagaaaccagaaaatacgagtttctaggacttaaatacgcagatttatgttttggtaaaggaggctcttacggtatatcagaagtaaaatacaacaaaataagagagaaagaggggatcggcaaagaatcagaatttaaatttacactatataaaaacgatctaatactaataaaagatacagaaacaaactgtcagcaatttttcagattttggtccagaacaggaaaagataaccccaagagctttgaaaaacataaaatagaattaaaaccttacgaaaaagcaaaatttgaaaaaggagaagaactagaagtattgggcaaagtaccgccatcatctaaccaattccagaaaaacatgcaaatagaaaacctctcgatatataaagtaaaaaccgatgtactcggcaataaacactttatcaagaaagaaggagacgaaccaaaactaaaatttaagaaatga

SEQ ID NO: 5159 - RNA, 3411 nt, synthetic construct
  misc_feature 1..3411: note = Cas9 variant
  source 1..3411: mol_type = other RNA
atgaatggccttgtcttaggtttagacataggcatcgcaagtgtaggggtcgggatactgaaaaaagacacgggagaaataatacatactaattctcgacttttcagcgctgccacagctgattcaaacatagaaagaagacgacatcgcggcgggaagagacttacaagacgaaaaaagcacagatctattagattacatgatttgttcgaagattctggattattaactgattttagcaaagtatcaattaacttgaatccataccaacttcgagttcaaggcttagacaaccaacttaccaatgaagaactattcatagctctcaaaaacatagtaaaaagacgaggtatatcatacctcgacgatgcttctgaagacggcggcacagtatcatcagattacggcaaagcagtcgaagaaaatagaaaactcctcgctgaacaaacaccgggacaaatacaattagacaggtttgaaaagtacggacaagtaagaggcgacttcacagttgtagaaaacggcgaaaaaagacgactaattaacgtattcacaacttcagcatatagcaaagaagcagaaaggatattgcggaaacaacaagaattcaataagaaaataacagacgaattcatcgaaaattatttaactatcttaacgggtaaaagaaaatattaccacggacctggcaacgaaaagtccagaacagattacggcaggtatacaacaaagaaagaccctgaaggaaagtacataaccctagacaacatatttggtatactcataggcaaatgtacgttctacccggacgaatatcgcgcgagtaaagcaagctatactgcacaagaatttaatctattaaacgatttgaataatttaaccgtacccacggaaacaaaaaaattgagtgaagaacaaaaaaaaacaataataaaatacgcgaaaacagcaaaaacactaggagcttctacactactaaaatatatagccaagttaataggagcatccgtagatcagatccatggataccgaatagatcccaacaaaaagcctgaaatgcatacctttgaaacttatagaaaaatgcaaagtttagaaacaattagtgtagaagaaataccaagaaaagtcttggatgagttagcacacatattaaccctgaacacagaaagagaaggaatagaagaagcaataaatgccaccctaaaagacacattcagtcaagaccaagtactagaattagtccaattcagaaaaaataactcatcattattttccaaaggatggcacaacttttctttaaagttaatgatggagttaataccagaactctacgaaacatcagaagaacaaatgaccatcctcacgcgactcggaaaacaaaaaagcaaagaaacaagtaaaagaacaaagtacattgacgaaaaagaattaacagaagaaatttacaaccctgtagtagccaagagtgtccgacaagcgataaagattatcaatgaagcaaccaaaaaatatgggatatttgataatatagtaatagagatggcaagggaaaacaatgaagaagacgcaaaaaagggatacaacgaaaggcagaaagccaatctcgacgaaaaaaaatcggcgatggaaaaagccgcatttcaatacaatggtaaaaaagaactaccagacaacgttttccacggacacaaagaactagcaactaaaataaggttatggcaccaacaaggagaaaaatgcttatataccggaaaaaacataccaatttcggacttaatccaaaaccaatacaaatatgaaatagaccacatactaccattaagtttatctttcgatgactctctctcaaataaagtactagtactagccacagcaaatcaagaaaaaggacaaagaacccctttccaggcactagacagcatggacgatgcctggagttatagagaatttaaaagttacgtaaaagacttaaaactactaagcaataaaaagaaagactatttactaacagaagaagatatatcaaaaattgaagtaaaacaaaaatttatagaaagaaacttagtcgacacacgctactcaagtagagtagtattaaatgcgctacaggacttttataaagaacatcaattcgatacaacgatctcagtagttaggggacaattcacgtcacagttacgaagaaaatggggactagaaaaatcaagagaaacatatcatcatcatgccgtcgacgctctaataatcgctgcgtcaagtcaactcagactatggaaaaaacaaaacaacccacttatttcatataaggaaggccaatttgtggatcaagagacaggtgaaataatatcactaagcgacgacgaatataaagaactagtattcaaagcaccgtacgaccatttcgtagacactctcaaatcaaaaaaattcgaggattcaatcctattctcctatcaagtagattctaaatacaatcgcaaaatatcggatgccactatatacgcaacacgtaaagctaaactcgataaagaaaaaaaagaatacacatatacactcggcaaaataaaagatatatacgcactgggttcagaaaaactcaaaacgggattttacaaattccttcatctctataaaaaggacaaaagccagttcctaatgtaccaaaaagatagaaaaacgtgggacgaagtcatcgaaaagatactagaacaatatagaccgttcaaagaaaaggacaaaaatggtaaagaagtcgatttcaatccttttgaaaaatataggatagaaaacgggccaatacataaatactcaagaaaaggcaacggacccgtaataaaatccctaaaatactacgacaaaaacatcccagagtcttttatcaatattacacccagtaattcaaaaaataaagttatattaaggcaattaaacccctggagaacagacgtatacttcaaccatcaaacagaaaaatatgaactattaggcttaaaatacgcccacttacagttcgaaaaaaaaaccggaaattacagcataacaatagataaatacaatgaaatcaaggaaaaagaaggagtctcagaacagtcagaattcaaattcacacttcataaaaacgatctattattaataaaagacaccgaaacaaaagaacaacaactattccgtttcctatccagaacaaaacctaacgtaaaacactatgtagagctaaagccatatagtagagacgaatttgaaaaaaacgaaagattgatcgaaatcctcggcagcgtagataaaagcggaagattcgtaaaaggattagggaaatcaaatctaagtatatacaaagtaagaacagacgtattaggaaaccaacacataataaaaaaagaaggagaagaaccaaaacttaaattttga

SEQ ID NO: 5160 - RNA, 3411 nt, synthetic construct
  misc_feature 1..3411: note = Cas9 variant
  source 1..3411: mol_type = other RNA
atgaatggactagtacttggattagatataggaatagcttcagtaggagtaggcatattagaaaaagacacaggaaaaattatccacgccagttccagactattcccggctgcaacagccgacaataatgtcgaaagaagatcaaaccgacaaggccgtagactaaatcgcaggaaaaaacatcgatcagtaaggcttcaagatttatttgaaggatacggactattaacagactttagcaaagtaagtatgaatctgaatccttaccaattaagggtacaagggatggaaaaccaactcacaaacgaagagttattcgttgcactgaaaaatattgtcaagagacgagggatatcatacttagatgatgcaagcgaagatggagggacagtatcctctgactacggaaaagccgtagaagaaaatcgcaaacttcttgcagaaaaaacaccgggacaaatacaattagaaagattcgaaaaatacggtcaattaagaggagatttcactgtagaagaaaatggagaaaaacatcgactaattaatgtcttctcaacatctgcatacagaaaagaagcagaaagaatccttagaaaacaacaagaatttaattccaaaatcacggatgagtttatagaagactatctaattatattaacaggaaaaagaaaatactatcatgggcccggcaatgaaaaatcaagaacagactatggaagattcaggacagacggaactaccttagacaacatttttggtatactaatcggcaaatgtacattctataccgaagaatatagagcaagtaaagcaagttataccgctcaagaattcaatctactcaatgacctaaataacttgacagtcccaactgaaacgaaaaaactctcagaagaacaaaaaaaattgattatagaatatgcaaaatctgcaaaaacactaggtgcaagtactctcctcaagtatattgctaaaatgatagatgcttcagtcgaccaaatacgcggataccgagtagacgtaaacaacaaaccagagatgcacacgttcgaggtatacaggaaaatgcaaagcctcgaaacaataaaagtagaagaattaccgaggaaagttttagacgaactagcgcacatactaactttaaacacagaaagagaaggaatagaagaagcaatcaatagcaaactaaaagacatatttaacagagaccaagtacttgagctcgtacagttcagaaaaaataatagttctctattttcaaaaggatggcacaatttctctatcaaacttatgatggaactaatacccgaattgtacgaaaccagcgaagaacaaatgacaatactcacaagattgggcaaacaacgcagtaaagaaacatcaaaaagaacgaaatacatagacgaaaaagaattaactgaagaaatatataacccagttgttgcaaaatcagtaagacaagcaataaaaatcataaacgaggctaccaaaaaatacggcattttcgacaacatcgttatagaaatggcccgagaaaacaatgaagaagacgcaaaaaaagactatatcaaacgacaaaaggccaaccaagacgaaaaaaatgccgccatggaaaaagcggcatttcagtacaatggcaagaaagagctaccagataatattttccatggtcataaagaactcacaacaaagatccgactttggcatcaacagggagagaaatgcttatatactgggaaaaacataccaatctccgacctaatccataaccaatacaaatatgaaatagatcatatactcccattaagtttaagtttcgacgacagtttatctaacaaagtactagtactggcaactgcaaaccaagaaaaaggacaacgtacacctttccaagccctcgattcaatggacgacgcatggtcttacagggaatttaaatcttacgtgaaagattcaaagttactcagcaacaaaaaaaaagattatctattaacagaggaagatataagcaaaatcgaagtaaagcaaaaattcatagaaagaaacttagtagacaccagatactcatcaagggtagttctcaacgcactgcaagacttttataaaagccatcaattagacacaactatttcagtcgttagaggacaattcacgagtcaactacgcagaaaatggggaatcgaaaaaagtagagaaacgtatcaccaccacgcggttgacgcacttatcattgcggcaagttctcaattacgattatggaaaaaacactccaatccactaatagcatataaagaaggacaatttgtagactcagagacaggagaaatagtatcactatcagacgaagaatacaaagaactcgttttcaaagcgccatacgaccattttgtagacactctaagatctaaaaaattcgaagacagtatattattctcttaccaagtagacagcaaatataaccgaaagatatctgatgctactatttatgcaacgaggaaagcgaagcttgataaagaaaaaaaagaatacacttacacactaggaaaaataaaagacatatacgccctcggtacaaagacaccctccaaaactggcttctacaaatttctcgacctatacaaaacagataaaagccaattcctaatgtaccaaaaagacagaaagacatgggatgaagtaatagaaaagataatagaacaatacagacctttcaaagaatatgacaaaaatggcaaagaagtcgactttaatccatttgaaaaatacagaatcggaaacggtccaatacgcaaatactctaaaaaagggaacggtccagaaataaaatcacttaaatactatgacatactactaggaaaacataaaaatataacacctgatggctcgcgaaataccgtagcattactttcactcaatccttggcgaacggatgtctactacaactcagaaactaaaaaatacgaatttctaggacttaaatatgctgacttatgctttgaagaaggtggagcatatggaatatcagaagtaaaatataaaaaaattagagaaaaagaaggcataggaaaaaattctgaatttaaattcacactatataaaaacgacctcatacttataaaagatacggaaacaaactgtcaacaattctttagattctggagcagaacagggaaagacaatcccaaatcctttgaaaaacataaaattgaattaaaaccctacgaaaaagccaaatttgaaaaaggagaagaactcaaagtactgggcaaagttccgccatccagcaaccaatttcaaaaaaacatgcaaatagaaaatttgtcaatatataaggttaaaaccgacatcttaggaaacaaacattttatcaaaaaagagggagatgaacccaaacttaaattcaaaaaatga

SEQ ID NO: 5161 - RNA, 3420 nt, synthetic construct
  misc_feature 1..3420: note = Cas9 variant
  source 1..3420: mol_type = other RNA
atgtcagaccttgttctaggcctcgatatcggaatcggatctgtaggcgtaggaatattaaataaagttaccggggaaataatccataaaaatagtagaatattcccagctgcacaggccgagaacaacttagaaagaagaactaatagacaaggcaggagattaacacgaagaaaaaaacatcgacgggttagactcaatcatttatttgaggaatcaggtttaataacagacttcacaaaagtatcgataaacttaaacccctatcaattaagagtaaaaggattaacagcagaattaagtaacgaagaattattcattgccttaaaaaacatggttaaacaccgaggaatctcatacctagatgacgcaagcgacgacggaaatagctccgtaggggattatgcgcaaatagtaaaagaaaactcaaaacaactagaaaccaaaacgcccgggcaaatccaactagaacgatatcagaaatatggtcaattgagaggagatttcacagtagaagaagacggcagaaaacacagactaataaacgtttttccaacatctgcgtaccacgcagaagcactacgcatcctacaaactcagcaggaattcaacccacaaataacggacgaattcatcaattcttacctagaaatattaacggggaaaagaaaatattaccatggtccaggaaacgagaaatcacgcacagattacggaaaatatacaacaaaaaaagatgcgcaaggacaatatattacactaaacaacatattcggtatcctaataggtaaatgtacgttttatccagaagaatacagggcagcaaaagcaagttatacagcacaagaatttaatttacttaacgacctaaataatttaacagtaccaacagaaacaaagaaactttcagaagaacaaaagtaccaaataataacatacgtcaaaaacgaaaaagcaatgggacccgcaaaactcttcaaatatatagcaaaattattatcatgtgatgtagctgatatcaaaggataccgaatagataaatccgacaaagcggaaatacacacatttgaagcttaccggaaaatgaaaactttggaaaccctagacgtcaaaaaaatggcccgagaagaattggataaattagcatacgtactaactctaaatacagaaagagaaggcatacaagaagcccttgaccatgaatttgcagatggtaccttctcacaagaacaagtcgatgaactggtccaattcagaaaagctaactcttcaatatttgggaaaggatggcattcatttagtgttaagctaatgatggagctaatacctgaactatacgcaactagtgaagaacaaatgaccatactaaccagactaggaaaacaaaagaccactagttcctcaaacaaaacaaaatacatagacgaaaaacaattaactgaggaaatatataaccccgtagtagccaaaagtgtgaggcaggcaatcaaaatagtcaacgcagcaattaaaaaatatggagattttgataacatagtaattgagatggctagagaaacaaatgaagatgacgaaaaaaaggcaatacaaaaaatacaaaaagcgaataaagcagagaaagatgcagcaatgagaaaagccgccaaccaatacaacggcaaagcagaattaccccactcagtatttcatgggcataaacaattagcaacaaaaattcgtttatggcatcaacaaggtgaacgatgcctttatacaggaaaaaccatctcaatacacgacctaataaacaacccaaatcaattcgagatagaccacattttgccactaagtataacattcgacgatagcttagctaataaagtcctagtatacgccaccgcaaatcaggaaaaaggacaaagaaccccataccaagcattagactctatggacgatgcctggagcttccgggaactgaaagcgttcgtaagagaaagtaaagctttgagtaacaaaaaaaaagaatatctactaacggaagaagatatctcaaaattcgacgttagaaaaaaatttatcgaaaggaacttagtagatacaagatatgcttcacgcgtcgtactaaacgcactacaagaacactttagaactcataaaatagacacaaaagtaagtgtagtacgaggacaattcacatcacaactacgaaggcattggggaatagaaaaaaccagagacacataccatcatcatgcggtagatgcactaatcatagcagctagctcccaactaaacctttggaaaaagcaaaaaaacaccttagtttcatattctgaagaccaactccttgacatcgaaacaggagaactgatctcagacgatgaatataaagaaagcgtatttaaagccccataccaacacttcgtagacacgctaaaatcaaaagaatttgaagactcaatcctatttagctaccaagtagacagcaaattcaatcgaaaaataagcgatgcaacaatatacgcaacaaggaaagctaaactagataaagaaaaaaaagaatatacgtacacgttaggaaaaataaaagacatctacgctttagggacaaaaacaccatcaaaaaccggattttataagtttctagatctatacaaaaaagacaaatcacaatttttaatgtaccaaaaagacaggcgaacatgggatgaagtaatagaaaaaatcttagagcaatacagaccttttaaagaaaaagacaaaaatggaaaagaagttgattttaaccctttcgaaaagtatagaatagaaaacggtcctatccggaaatattccagaaaaggcaacgggcctgagataaaatccctgaaatattatgataacctactaggaagatttgtagacataactcctagcgaaagtaaaaacccagtcgcgctactatctttaaacccatggcgaactgatgtatactataatacagaaaccagaaagtacgaattcctgggcttaaaatacgccgacctatgttttgagaaaggtggatcatacggaatatctaaagttaaatacaataaaatacgagaaaaggaaggtataggtaaaaatagtgagtttaagtttactctttacaaaaatgacttaatattaataaaagatacagaaacaaacagacagcaaatatttagattttggtcaagaacaggaaaagacaacccaaaatccttcgaaaaacataaactagaactcaaaccatatgaaaaaaccagattcgaaaaaggtgaagaactaaaagttctaggaaaagtcccgccatcaagcaacagattacagaaaaatatgcagatagaaaatttatccatatacaaagtcagaacagatgtactaggaaaccaacacatcattaaaaacgagggtgataaaccaaaactcgacttttga

SEQ ID NO: 5162 - RNA, 3420 nt, synthetic construct
  misc_feature 1..3420: note = Cas9 variant
  source 1..3420: mol_type = other RNA
atgaactattataatggattcataataaccgaaaatgcaatggcctcgaaacacgaaaatttgggcgcattaacatttggattagacattggaatagctagtgtaggttgggcggtactaggcgaaaatcgaataatagatttaggagtacgctgttttgataaagcagaaactgcaaaagaaggtgaatccttgaacttagcgagaaggacagcgaggttattaagaagacgacttaggagacgagcatggagacttacaaaactagcaagactactaaaacgagaaggattaatagcagacacaaatgtttttcaaaaaccattcaacttgaaagatgcaaacgaaaaaggtctaagtttctggcaattaagagtagacgctttagacagaaaattaagtgcagaagaatgggcgagagtaatctaccacctatgcaaacaccgtggattccattggatcagccgagctgaagaaaaagcagcagagggagattccaagagcgaaggtggaaaagtaaaacaaggattggcaggaactaagaaactaatgcaagagaaaaattaccgaactgccgcagaaatggtcctcacagaatttccagaagcccaaagaaataaacaaggagactatagcaaagcactatccagaatactactaggagacgaaatgactcaattattcaagcatcaacgagaacttggaaacccacacgcaacagaaaagttagaagcagccatactaggaaatggagaccacaaaagtggactattttgggcccaaaacccagcattagccggaaatgatttactaaaaatgctaggacattgcacatttgaaaaagccgaatatagagtcccaaaagcatcttttacagctgaaaggcatgtttggttaactaggctaaataatttaagaattgtcgtagacggaacaactagaccattaaacgaagctgaaaggcatctggcccttttaatgccatatcaacaagccggtgatttaacatataagcaattacgaacagcattaaccaaagcagggtatttaccagaaagttttcgatatacaggtctagcatatgcatcgggtcaaaaagcggatgaaaaagctaaagaccccgaatcagcacctttagtaaaacttccggcctggcatgaattgagaaaaaccttggaaaagaaagaattagcctccgaatggcagaaaatttcatccgatgcacttgatggaaaaccacaattactcgatcaaatcgcctgggtattaagcgtatacaaagacgataccgaagttgaggcagaactatgcaaattaaatctaccaaatgcagagaaaatgatagatgcacttctagatatacgttttgacaaatttagtaatctgtcgctaaaagcactgagacaaattgtaccactaatggaacaaggtcaaagatacgacgaagcggtggctaacattccagaatatggccatcactcacaattacatgaagttggcgcgggtgaacataaatacttaccaccattttataaagaacgagataaaacaggtaggatggtattcaatgacgatatggatatcccacgaaaccctgttgtcttaagagcattaaaccaagctagaaaagtagttaacgctctaattaaagaatatgggagtccacacgaagtacacatagaaatggcgagagatttaagtagaccacttgatgaaaggcgtgatgtcgaaaaattacaaaaagagttccgcgatcgaaatgaaaaagacaaggctttattcgcacaagattttaatatagtaggagcagttaaaggcaaagaatttgaaaaatatcaattatatagggaacaacaagggaaatgtgcgtattctatagaaccaatggatattcacaggttattcgaacaaggatacgtagaaattgatcatgcactaccatatagtagatcattcgatgacagcaaaaacaacagagtattagtcctagcaaaagaaaatcgtgataagggaaacagaacaccatttgaatatttagggggcaaggacaactcagaaaggtggcggcagtttgtagcatttgtagaaggtaataaatcatacagactagcaaaacgatctaggttgctaagaaaagactttggaaaggatgaagcaaaaggctttagagaaagaaatttaaacgatacaaggtatatatgtagattctttaaaaattacgtagaacaatatttgcaacttcatgaagacagtgacgctaaacgttgcgtagtcttatcaggacaaatgactagctttttacgagcacgttggggattagtaaaggtccgaggagattcagacagacatcacgccctcgatggagcaatagttgcagcatgttcacattcaatggttaaacggcttagtgactactcaagaagaaaagaattagaacaagtaagggcaggttttgtagatgtagacacgggagaaattgttaatccagccatgtttcaacaagtacaagagcatttcccaaatccttggccacatttcagagatgaagtcaaattaagattaaacgtagatgacccagctctgttacactcagaaatgaatagatttggtacttattcaccagaagcattgaaggctttacgacctctttttataagtagagcaccacaaagaagaaatagtggcgcagcacacaaagataccatatacgcacaaccagaaagattagttgctcaaggtggtgtaacacaaaaagtaccactaaccagtttaacgctaaaagatttagacaaacttatcgatccacatagaaatgaaaaattatattcagcaataagaataaggctagaacaacatggaggaaaaggagataaagcattcccagcttcaaatccattaagaaagccagattcggaaggcaaccccacaggccccatagtaaggggcgtaacaatggtcatcgataagctcagtggaatcccaatacggggcgggatagcgaaaaacgatagtatggtccgtgtcgacgttttcaccaaagcaggcaaattccatctagtaccagtatacgttcatcacgcagtagcgaaagtattgccaaatagggctgtggttgcatataaagatgaaacagaatggactttaatagacgatggattcgatttttgtttttcaatgtaccctaatgaccttttaagaataaagttgcgtaatgcaagccatcttggttattatgcttcttgcaataggagcacaggtgcaattaacttatggagtcatgacagaaatcaacaggttggcaaagacgggatgatagaatcaataggggtcaagacagcactaaatgttgaaaaactaaatatagacgtactagggaataggtatcctgcaccacccgaaaaacgaagagatttagcttga

SEQ ID NO: 5163 - RNA, 3423 nt, synthetic construct
  misc_feature 1..3423: note = Cas9 variant
  source 1..3423: mol_type = other RNA
atgaaaaacatgacaaaagtaaacgtcggtctagacgtaggaatctcttctgcaggctggtcagtcatcaatgcagaaacaaaccaaatacttgaatccggagtccgacttttcagcggatcagacgcagacgagaatgtcaacagaagaaaccaacgacaaggacggagactattcagaagaagaaaactaagaatacaagaagcaaagaaataccttgaaaacgtctttcaactaaaagatatagaaccaaaagacgaatggaacccatacgaaataagagtaagagctttaaatgaaaaagtaagcaaagaggaattgagcatcgcccttttaaatatagttaaacatagaggaatatcatatgaactcgaagacgtaacagatgaagaaggaacaaatacacaatcattccaatcaggattagattataacagaagactcctgaaaacaaaaacagtaggagaaatacaatatgaccgtctccagaaatatggtcaagtgagaggacaaatacagacagaggatggtctactaataaacatcttccccactaaaaactacgtagaagaagtagaaagaatattagaaacacaaaagaaataccaccccgaaatagacgacgtgttcatagagaaaattatcagcttcgtaacacgaaaaagagaatatttcgtcggaccgggaaacgagaaaagcagaacagactacggaatctaccgggaaaacggtgaaacactagataacctttttgaaatattgataggcaaagataaattctacccagaagaatacagagcagcaggttcatcgtatacagcacaaatatttaatcttttaaacgacctgaacaacctaagaatacctacaacagaagatcatcacctcactaaagcccaaaaggaagaaattataaccgaactcaaaaacacatcaagactatcaggaggaatgctaaaattaatctccaaggtcacaaaagccccaaaagaagaaatatctggatacagaaaagacgaaaaagataaaccagatctccattcactagcctattatcgaaaacagaaaaatatgttagaaaaagaaggcatccaaatagcagattttagtgaagaattgttagacgaacttgcaacaatgatgacattaaacacagaaccgggggaaataagaaaacaattaaacaaaataacaaaccaatacgacatacttacaccagaagttatagaagttctagtcaaaaatcatacggcatttgtagcaacatctaatcataaatggcatagattttctctaaaattaatgaaagagttcattccagaactactagaaacgagcaaagaacaatccaccatcctatgcgagagaggattcatacaaaatagagcaagttatttagatgaaaatcatcactttaattacgcagaattacgcgagaatctatataacccagtagtaagaaaatcaacatgtgaaatgttgaaagtattcacagccatacaggaaaaataccccaacattcaaaatgtaatagtagagcttcctcgcgaaaccaacgaagatgaacaaaagagaaaaataaagaaaataaacgacaacaatgcaaaacgaaagaaagagattttaaaagaagcccaagcacaatcaggactctctgaagaagctcttgaagaaaaactgttgaaaacaaaaggactatatttaaaactcatgctttggtatgaacaagaaggcaaatgcgtctattcaggacaagagataccgttatctgacctactgcaaaataaaggtggatatgaagtagaccacattatacccataagtatatcattcgacgataggttatgtaacaaagttctagtaagacaacaactaaactctcagaaaagcaaccaaacacccttcgaatatatgacaacacacacagatggacacctatctttccacgaattaaaagaattagtcggtaaaaacaaaagattctcaaaagagaaaagggaactactcctagcagaaatatactcaaacgacatcgaaacacgaaaacgattcataaacaggaacctagtggatacatcatacacagcaaggatcgtattgaacgcccttcaacaatacaagaaagaaaaccaactaagcatgaacgttagcgttgtacgaggagcaatgacaaacattctacgaaagaaggtaaagctagacaaaacaagggagacattccaccaccacgcgatagacgcgagcctaatggcagtcataccaaacattgagttcttcaaagaacgaaaagaatggttaccaaaaagcgcaaatgaagaagtagtagaagtagaagtttctgaagaagaaaccatgcccgaaaaagaatttaaagtaaaaatgagattaccggaaagtttcatccaagatgtgcaaatactacaacgaaacagcttcgcaaaagaagaagtaagcggaccacaaacaagagaacgaaaccttaaaataaaattcagccaccaagtagaccagaaaatgaacaggaaagttgcggacgacacaatttatggaacgcgtcaagcgcaactaggaaaagacaagaaagaagaaacatacgttataggaaaaattaaagacatatacaactacgatgaatatgtaagattcaagaaacgatatgacaaaaacaaagagagcttcctaatgtatcaccatgacccacagacatttgagaaactagaagaaattctagctcaataccctgaatatatagaagacgaaaaaggaaagaaaaagaaagtatctccattcgctctatatcgagaagaaaacggcccagtaacaaaatacgcaaagaaaaataacggaccagtaatcaaacagttaaaatactatgacagcaaacttaaccgcaaaatagatatatcacacaaatatagcaccaaaaaccgacaagtggtactccaaagcctcaaaccttatagaacagatgtatacagaaatcaagatacaggagaatatacactggtgggaattgaccagaatgatggtaaatttgtaaacggacactacggtatacccaaaagtagatatgaagaaataaaagccaacaataaattaagcgaacacgacgaatttgtattctccctatataaaaactctatggtaaaagttatagatgaaaacggcgaaagcatagtagttagatacctatcaagaagtatgccaaaccgtaaaaacaacgcagagattaaaccggtggaaaaataccaattcgaagatggagaggtagtacctgtatacggtaaatgcagaaaacaaatgcaaacagtatttgtcaaaaagggctggacgttactaaaaggaaacacagacattctaggaaatacctacttcgtagaaaaagaaagtgagaacccaaagaaaatgattgatgataaatga

SEQ ID NO: 5164 - RNA, 3423 nt, synthetic construct
  misc_feature 1..3423: note = Cas9 variant
  source 1..3423: mol_type = other RNA
atgagagaaaacggaagtgacgaaagaagaaggaatatggatgagaaaatggactataggatcggactagacatagggatagcaagtgtcggttgggctgtattacaaaataacagtgacgatgaaccagtgagaatcgtagacctgggcgtaagaatatttgataccgcagaaatacctaaaacaggcgaatcattagctggaccacggagagcagccagaacgactagacgtagattaagacgccgtaaacacagacttgaccggataaaatggttattcgaaaaccaaggactaataaacatcgatgactttttaaaaagatataacatggcaggcttaccagatgtataccaattaagatatgaagccttagatagaaaattgacagatgaagaactggcacaagtactactacatatagcaaaacacaggggatttcgcagtacgaggaaagcagaaaccgcagcaaaagaaaatggcgcagtactcaaagcaaccgacgaaaaccagaaaagaatgcaagaaaaaggttaccgaacggttggggaaatgatatacctcgacgaagcatttcgaacaggttgctcatggagcgaaaagggttatatactgacacccagaaacaaagccgaaaattatcagcacacgatgctaagagctatgttagtcgaagaagtaaaagaaatttttagtagccaaagacgtctaggcaatgaaaaagctacagaagaactagaagaaaaatacctcgaaataatgacaagccaacggtcatttgatctaggaccaggaatgcaaccagatggcaagcctagcccttatgcaatggaaggattttcagatagagtcggaaaatgcacattccttggagatcaaggggaacttagaggagcaaagggaacttatactgcagaatatttcgtagcactacagaaaataaaccacactaagctagtaaatcaagacggcgaaactagaaattttacagaagaagaaaggcgggcattgactctattactctttactcaaaaagaagtaaaatatgcagcagttagaaagaagctgggattgccggaagatatattattctacaatcttaactataagaaagcagcaacaaaagaggagcaacaaaaagaaaaccaaaatacagaaaaagcaaaatttataggtatgccttactatcacgattataagaaatgtctcgaagaaagagtaaaatatttaacagagaacgaggtacgtgatttattcgacgaaattggcatgattttaacatgttacaaaaatgatgacagtagaacagagaggcttgcgaaattaggtctagtaccaatagaaatggagggactgcttgcatatacgcctacaaagttccaacatttatcaatgaaagccatgcgaaatataatcccatttttggaaaagggaatgacatacgacaaggcttgcgaggaagctggatatgactttaaagcagactccaaaggaacaaaacagaaattattaacaggagaaaacgtcaatcaaacaataaatgaaataactaatcctgtagttaaacgcagtgtgagtcaaacagtaaaagtgataaacgcaataattcgcacctatggaagccctcaagcaataaacattgaacttgcccgagaaatgagcaaaacattcgaagaacgaagaaagatcaagggtgacatggagaaaagacagaaaaataatgaagatgtcaagaaacaaattcaagaactaggaaaattatccccaacaggacaggacattctaaaataccgtttgtggcaggaacaacagggcatatgcatgtactcgggaaaaacgataccattagaagaattatttaaaccaggttacgatatagatcatatactaccatactctataacattcgacgactcgtttagaaataaagttctagtaacctcgcaagaaaacaggcaaaaaggaaatcgaaccccatatgaatatatgggcaatgatgaacaaagatggaatgaatttgaaacgagagtaaaaacaacaataagggactataagaaacaacaaaaactacttaagaaacatttctcagaagaagaaaggtcagagttcaaagaacgaaatttgacagatactaaatacataacaactgtaatctacaatatgataagacaaaacttggaaatggcgccactaaatcgtccagagaaaaagaaacaagtaagagcagtaaatggtgcaattacagcatacttaagaaaacgctggggattacctcagaaaaatagagaaactgacacccaccatgcaatggacgcagttgtaatagcatgctgcacagacggtatgattcagaaaataagcaggtacaccaaagttagagaacgttgttattcaaaaggtactgaatttgttgacgcagaaaccggtgaaatttttagaccagaagactattccagagccgaatgggacgaaatatttggtgttcacataccaaaaccctgggaaacattccgggcagaattagacgtacgaatgggagacgatcccaaaggatttctagatacacacagcgacgtagccctagagctagactacccagaatatatttacgaaaacctaagacctatatttgtgagtcgtatgccaaatcataaagtaacaggagcagctcatgcagatacaatacgatcacccagacattttaaagatgaaggaatagtactaacaaaaactgcactaacagacctaaaattggacaaagacggagaaatcgacgggtactacaacccacaaagcgatctattattatatgaagcactgaaaaagcaattattattgtacggtaatgacgcaaagaaagcatttgcacaagatttccacaaacctaaagccgatggtacagaaggaccggtggtacgaaaagttaaaatacaaaagaaacaaacgatgggagtatttgtcgattctggtaacggaattgcagagaacggtggcatggtcagaatagatgttttccgagtcaatggaaaatattactttgtacctgtatacacagcagacgttgttaagaaagtactaccaaaccgcgcgtcaaccgctcataaaccatatggtgaatggaaagttatggaagacaaagatttcttatttagcctatactcaagagatttgatacatattaaaagtaagaaagatataccaatcaaaatggtaaacggaggaatggaaggaataaaagaaacctatgcttattacataggagcagatatcagtgcagcaaacatacaaggtatagcacacgacagccgatacaaatttagaggtttaggaatacaatcactggatgttttagaaaaatgtcaaatagatgtgttaggacatgtctccgtcgttcgaagtgaaaaacgaatgggattttcatga

SEQ ID NO: 5165 - RNA, 3423 nt, synthetic construct
  misc_feature 1..3423: note = Cas9 variant
  source 1..3423: mol_type = other RNA
atgaacggattagtactaggactagacatcggaatagcatctgttggagtaggaatactagagaaaaacagtggaaagattgtacatgcctcgagcagaattttccctgccgcaaccgcagataacaacgttgaacgccgaaagaatcgacaagcgagacgactgaacaggaggaagaaacaccgcggcgtccgatttcaagatctattcgaagactatggcctacttacagacttctctaaagtttccattaacttaaacccttaccgactacgagttgacggacttaatcaacaactaactaatgaagaactattcattgcactaaagaacatagttaaacgtagaggcatttcctatctagacgatgcctcagaggacggtggaacagtatcaagtgattatggaaaagccgtagaagaaaacagaaaattattagccgagaaaaccccaggtcagatacaactagaaagattcgaaaaatacggacaactacgaggcgatttcacggtagtggaaaatggagaaaaatgtcgtctgatcaatgtatttagcacatcagcatataagaaagaagccgaacgcatcttaagaaaacaacaagattttaacaaccaaataacggacgaatttatcgaagattacctaaaaatactcactggaaaaagaaaatattaccatgggcccggtaatgaaaaatcaagaacagactacggaagatacacaacacataaagactcaaaaggagaatacgtaacattagacaatatattcggagtactcataggtaaatgcacattttacccaaatgaatatcgagcaagtaaagcatcttacactgcccaggagttcaacctactaaatgacttaaacaacttaaccgtccctacagaaacaaagaaactatccgaagaacaaaagaaaaccataatagaatacgcaaaatctgccaaaactttaggtgcaagcacactattaaaatacatagcaaaaatgatagacaccagcgtagaccaaatacgaggatatagagttgacgtaaataacaaacccgaaatacatacatttgaagtgtacagaaaaatgcaatcactagagactatttcagtaggagaactatcgcggaatgtgttagacgaactcgcccatatactaacactaaacaccgaaagagaaggaatagaagaagcaataaataccaaactaaaagactccttctctcaagaccaagtacttgaacttgtgcaattcaggaaaaacaattcgtccctcttctcaaaaggttggcacaactttagcctaaaactgatgatggaactaatccctgaactatacgaaacaagtgaagaacaaatgacaatactaaccaggctagggaaacaaaaatcaaaagaaacaagcaaaagaacaaaatatattgatgaaaaagaactcaccgaggaaatatacaatccagtagtcgccaaatccgttcgacaagcgatcaaaattataaatgaggctacaaagaaacatggaatttttgacaatatagtcatagaaatggcaagagaaaacaacgaagaagatgcgaagaaagactatataaaacgccaaaaagcaaaccaagacgaaaaatacgcagccatggagaaagcagctttccaatataacggaaagaaagagctaccagacaacatatttcatggccacaaagaattagcaacaaaaattcgactctggcaccaacaaggagagaaatgtttatatactggaaaatcaataccaatatcggatctaatacacaatcagtacaaatacgaaatagaccatattttaccactctcattaagtttcgatgatagcctaagcaacaaagtcctagtactagctacagctaaccaagaaaaagggcagcgtacaccatttcaagcactcgactcaatggatgatgcatggtcgtacagagaatttaaaagctatgtaaaagagtcaaaactattaggaaataaaaagaaagaatatctacttacagaagaagatattagcaaaatagaagtaaaacaaaaatttatagaaagaaatctcgtagatacaagatactcttcacgagtcgtcctcaacgcattacaagacttctacaaaaaccataactttgacacgacaatatcagtcgtaagaggccaattcacatcacaactcagaagaaaatggggtctggagaaatccagagaaacttatcaccaccatgctgtagacgcattaataatagctgcgagctctcaattacggttatggaagaaacaaaacaaccctctgatagcttataaagaaggacaattcgtagactcacaaaccggagaaatcataagtctcaccgacgatgaatataaagaactcgtctttaaagcaccatacgatcatttcgttgatacactatccagcaaaacatttgaagattcaatcttattctcataccaagtagacagtaaattcaatagaaaaattagcgacgcaacaatttatgctacaagaaaagcaaaactagataaagaaaagaaagaatatacatatactctaggaaaaataaaagacatatattcactaggaacaaaaactccatccaaaactggattctataaattcctagacctttataataaagataaatcacaattcctaatgtttcagaaagatagaaaaacatgggacgaagtaatcgagaaaataatggaacaatacagaccctttaaagaatatgataaagctggaaaactcgtagacttcaatccttttgaaaaatatagacaagaaaacggaccaataagaaaatatagtaagaaaggaaacggccctgaaataaaatcattaaaatattacgacatactactaggtaaacataaaaacataacgcctgaaggctcaagaaacacagttgcactactaagcctaaatccctggagaacagatgtatactataatatggaaaccaagaaatacgagttcctgggtttaaaatacgccgatctaccattcgaagaaggaggggcttacgggattagcacagaaacatacaacgagctaagagaaaaagaaggcatagggaaaaattctgaatttaaattcactctgtataaaaacgatttaatacttataaaagacacagaaaccaactgccaacaatttttccgattttggtcaagaacaggaaaagacaaccccaaatcattcgaaaaacacaaaatagaactaaaaccatatgaaaaagcaaaatttgaaaaaggagaggaactagaagtattaggcaaagtaccaccaagctcaaaccaattccaaaagaatatgcagatcgaaaacctaagcatttacaaagttaaaactgacgttctaggaaacaagcacttcataaagaaagaaggagataagcctaaactaaaattttga

SEQ ID NO: 5166 - RNA, 3423 nt, synthetic construct
  misc_feature 1..3423: note = Cas9 variant
  source 1..3423: mol_type = other RNA
atgaatggcctagtattagggttagatattggtatagcttccgttggagtcggaatcctaaaaaaagatataggtgaaataatacacacaaattccaggctatttagtgcagccaccgcagacagtaacatcgagaggagaggtcatcgcggcggaaaaagactcacaagaaggaagaaacacaggagcatacgccttcatgacctattcgaagacttcggattgttaaccgacttctcaaaagtaagtattaaccttaatccgtaccaacttagagtacaaggtctagacaaccagttaacaaacgaagaactatttatagctctaaaaaacattgtcaaacgaagaggcataagttacttagacgacgcaagcgaagatggaggtaccgtatcatcagattacggaaaagcggtcgaagaaaatagaaaattactggctgaacagacccctggccaaatccaactagatcgatttgagaaatacggacaagtacgaggtgatttcaacgtagtggaaaacggggagaaacgcagacttataaacgtcttcacaacgagcgcatattcaaaagaagcagaaagaatacttagaaaacaacaagaattcaataaaaaaataacagacgaattcatagaggattacctaacaatattaacaggaaaaagaaagtactaccatgggccgggtaatgaaaagtcaagaacagattatggaagatacacaacaaaaaaagatccggaaggtaaatacataaccttagataacatatttggcatacttataggaaaatgtacattttatcccgacgaatacagagcaagtaaagcaagttacacagcacaggaatttaatttacttaatgacctaaacaatctcacagttccaacagaaaccaaaaaattaagtgaagaacaaaaaaagaccataattaaatacgctaaaacagccaaaacactgggagcatcaaccctactaaaatatatagcgaaattaattggagcaagtgtagaccaaatccatggatacagaattgaccctaacaaaaaaccggaaatgcatacctttgaaacatatagaaaaatgcaaagcctagaaactataagtgtagaagaactaccaagaaaagtactagacgaactagctcacatcttaacattaaacaccgaaagagaaggaatagaagaagcaatcaacgcaacattaaaagatacgttctcacaagatcaagtattagaattagtccaatttcggaaaaacaacagctcgttattctccaaaggatggcactcctttagtctaaaacttatgatggaacttatacctgaactatacgaaacatcagaagaacaaatgacaatcctaacgagattaggaaaacaaaaatcaaaagaaacatcaaaaagaacaaaatacatagatgaaaaagaactaacagaagaaatttataaccccgtagttgcgaaatccgttcgacaagcaataaaaataatcaacgaagcaacgaaaaaatacggcatattcgacaatatcgtaatagaaatggccagagaaaacaacgaagaagatgcaaaaaaagaatacattaaaagacaaaaagctaacctagatgaaaaaaacgccgccatggaaaaagcagcattccaatacaatggtaaaaaggaattaccagacaacgtatttcacggccataaagaactcgccaccaaaatcagactatggcatcaacaaggagaaaaatgtttatatactggaaaaaatatacctatttccgacctcatacaaaaccaatacaaatacgaaatagaccacatactacccttaagtttatcttttgacgatagtttgtcaaataaagtactagtcttagctacagcaaaccaagaaaaaggacaacgaacgccatttcaagcattagatagcatggacgacgcttggtcatatagagaatttaaaagttacgtaaaagacagtaaacttctcggcaataaaaaaaaagaatacttattaacagaagaagatatatcaaaaatagaagtaaagcagaaatttatagagagaaacctagtagataccagatatagcagtcgggtggtattaaatgcgttacaagacttctacaaagaacatcaatttgatactacgataagtgtagtacgaggacaattcactagccaattacgtagaaagtggggtttagaaaaaagcagagaaacataccatcaccacgcggtagacgctttgattatcgcagcaagctcccaattacgactatggaaaaaacaaaacaaccctttgatctcatacactgaaggacaatttgtggaccaagtcaccggggaaataatttcattaagcgacgacgaatataaagaattggtgttcaaagccccatacgatcacttcgtagatacgcttaagagtaaaaaatttgaagacagcattttattttcataccaagtagatagcaaatacaaccgcaaaatatcagacgcaaccatctacgcaactcgaaaagcaaaattagataaagaaaacaaagaatacacatacaccttaggcaaaataaaagacatctacgcgctaggtactaagtcgccatcgaaaacaggattttataaatttttagatttatacaacaaagataaaagtcaattcttgatgttccaaaaagatcgaaaaacttgggatgaagtaatcgagaaaataattgaacaatataggcctttcaaagaatatgatgaaaatggaaaagaagtagacttcaacccattcgagaaatatcgcatagaaaatggtccaatcagaaaatatagcaaaaaaggaaacggacctgaaataaaaagtttaaaatactacgataatttactcggcaaatttgtagatatcacgccgagtgaatcgaaaaacccagttgccctactctctctaaatccatggaggactgacgtatattacaacaccgaaacatcaaaatacgaattcctaggactaaaatatgccgacctatgttttgagaaaggaggcgcctatggaatttcagaagtaaaatataataaaattcgagaaaaagaaggaatcgggaaagaaagtgaattcaaattcacactgtataaaaatgatcttattttaatcaaagacacagaaacaaactgccaacaaatattcagattctggtcaagaaccggaaaagacaaccctaaatcgttcgaaaaacataaaattgaactcaaaccatacgaaaaagcaagattcgaaaagggagaggaattagaagttttaggcaaggtacccccctcgtctaatcaactccaaaaaaatatgcagatagaaaatctctccatttataaagtaaaaacagacgtacttggaaacaagcacttcataaaaaaagaaggtgaagaacccaaactaaaattctga

SEQ ID NO: 5167 - RNA, 3423 nt, synthetic construct
  misc_feature 1..3423: note = Cas9 variant
  source 1..3423: mol_type = other RNA
atggaagaaaattttcagtatagaattggacttgatatagggattacctccgtaggctgggccgttttacaaaacaactcacaagacgaaccagtaagaataacagatttaggcgtaagaatattcgatgtagcagaaaatcccaaaaatggcgatgcgctagcagctccacgaagagatgcccgaactacgagaaggcgactacgcagaagaagacatcgattagaaagaataaaattccttttacaggagaatggcttgattgaaatggattcgttcatggaaaggtattataaagggaatcttccagacgtataccaactaagatatgaaggattggacagaaaattgaaagacgaggagttagcacaagtgctaatacacattgctaaacatagaggatttcgaagtacaagaaaagcagaaacaaaaggaaaagaagggggtgcagtactaaaagctaccacagagaatcagaaaataatgcaagaaaaaggctacaggacagttggagaaatgttatacctagatgaagcattccatactgaatgtttatggaatgaaaaaggatacgttttaactccaagaaataggccagacgactataaacatacaattctacgaagcatgttagttgaagaagttcatgcaatattcgctgcacaacgagcactaggaaatgaaaaagctacagaagaattagaaaacgcttacgtagaaatcatgacaagccaaagaagtttcgatatgggtccaggattacaaccagatggtaagccaagtccatatgcaatggaaggctttggagacagggtagggaaatgtacatttgaaaaagacgaatatagagcaccaaaagcaacctatactgcagaactttttgttgcactacagaaaataaatcacacaaaactaatagatgaatttggaactggaaggttctttaccgaagaagagagaaaaactataatagatttactcttatcaggcaaagaactcaagtacggaacaataagaaagaaattaaatatagatccaagcctaaaatttaactcattaaattactcagcaaagaaagaaggcgagaccgaagaagaaagagtaagggatactgaaaaagcgaaatttgcttccatgttctggacatatgaatacagtaaatgccttaaagacagaaatgaagagatgacagtaggccaaaaagcagacctccttgatcgtataggagaaatactaacagcatacaaaaatgatgatagccgatctagtcgactagaagatctaggattaagtcgtgaggaaatagacggcttattagaactatcaccagccaaatatcaacgagtatcactaaaagcaatgcgaaaaatgcaaccttatctggaagatggcctaatctacgataaagcatgtgaagcagcaggatatgactttcgtgcattgaatgatggcaacaagaaacatttactaaaaggcgaggaaattaatgcgatcgtaaacgatataacaaacccagtagtaaaaaggtcagttagtcaaacaattaaagtaataaacgctatcattcaaaaatatggaagtccacaagctgtcaatatagaactagcaagagaaatgtccaaaaattttcaagatcgaacaaatttagaaaaagaaatgaagaaacgacaacaagaaaacgaaagagctaaacaacaaataatagagctaggtaaacaaaatccaaccggacaagacatattaaaatacagactgtggaatgaccaaggaggctactgcctttattcaggaaagaaaattccacttgaggaactttttggaggcggatatgacatagatcacatactcccctattcaattacatttgatgatagttatagaaataaagtacttgtaacagcccaagaaaatcgacaaaaaggtaatagaacaccttatgaatattttggagcagatgaaaaacattgggaagattacgaagcaagagttagattattagtaagagactataagaaacaacaaaaattgctaaagaaaaattttaccgaagaggaaaggaaagagttcaaagaaagaaatttaaacgacactaaatatataacaagagtagtgtataatatgatccgccaaaatctagaattagaaccttttaaccatcccgagaaaaagaaacaagtatgggcagtaaacggagcagtcacatcatatttaagaaaaagatggggacttatgcaaaaagatagaagtacggatcgccatcatgcaatggacgctgtcgtaatagcatgttgtaccgatggaatgatacataaaatctcaagatatatgcaaggaagagaacttgcatacagccggaacttcaaatttccggatgaagaaacaggtgaaatcctaaatagggacaattttacaagagaacaatgggacgaaaaatttggagtaaaagtaccgttaccatggaactcatttagagacgaattagatattagacttctcaatgaggatccgaaaaactttcttctaacacatgcagacgtgcaaagagaattagattacccaggatggatgtatggagaagaagaatcacccatcgaagaaggcagatacataaattacatacgcccattatttgtaagcagaatgccgaaccataaagtaacaggaagcgcacacgacgccacaatcaggtcggctagagactacgagactcgaggcgtagtaataaccaaagtacccctaacggatctaaaattgaataaagataacgaaattgaaggttactatgataaagacagtgatcgactactataccaagcattagttcgacaattactattacatggaaacgacggaaagaaagcattcgctgaagatttccataaaccaaaagctgacggtacagaaggtccagtggtgaggaaagtcaaaatagaaaagaaacaaactagcggagtaatggtcagaggcgggacaggaattgcagcaaatggcgaaatggtaagaattgatgtatttagggaaaatggcaaatattactttgtgcctgtatatactgcagatgtcgttagaaaagttctgcctaatagagctgcaatgaatggaaaaatagcgagtgattggaaaacaatggaagacaacaattttgtttttagtctgtatagtagagacttgattcatgttaaaaggaagaaagcgattcctacaattctaagttctggtgcaactttcgaacaagaagaattttatgcgtattttacaggtgcagacataagcacagtgtctatagcgggcatatcaaatgacaacagttttaaattcagaggtcttgggattcagggattagaaatatttgagaaatgtcaagtagacatattaggcaatatatccgtcgttagacatgagaatagacaaggatttcattga

SEQ ID NO: 5168 - RNA, 3426 nt, synthetic construct
  misc_feature 1..3426: note = Cas9 variant
  source 1..3426: mol_type = other RNA
atgtactcaattggattagatataggaattgcaagtgttggctactccgtaatagagacaaactcagggagaatagtagaattaggcgcaagaatttttgaagccagaaatagcgacaataacaaagatagacgagatttccgaggagggagaagactcattagacgtcgaaagacccgattagacgacgctaaaagatacttagatgaccaaggatttaaaaacgataaatcgttaataaatgtatgcccatatagtctaagagttaaaggattaaccgaagaactttcaaaatcagaaatccgaaaagtaattctacacatattaaaaaaacgtggagtctcatatttatcatctgaagacttagacacaagtagtgtggacaacaaagactcattcaaacaagcggtaacaaaaaatcttaggcaactcgatgataaaacaccaggacaaatacaatatgaaagattacaggaatcaggcagagtccgaacggggataaaccagaacggacaataccaattaaacgtatttgatgttgcatcatatgcaaaagaactaaaactaatcttagaaacacaacaacaataccatcaagaaatagacgaccactttctagacttctttactaaagacgggtatcgggaagatgcaggattgatttacagaaaaagaccatattacgacggaccaggaaacgccgcccaaaactcatcgtatggacgttgggcaaactaccaagtcgatggaaaacctgccgaaaacatattcgatcaactaattggtaaggatttcacaggaaaaataagagcatctaacctaggtccaagcgcgcagaaatttaacctcttaaatgacctaaataatttacgaattacaacaagagaagaggaaaaactaacttttgaggaaaaacaagaaatattagaagtactagaaaacgatagacccaaaaccttcggcccacgaaacattgcaaaaatgttgaaagtcgatatggacgacataaaaggatggagacttaactcctcagataaacctgaaatccatacaatgaaggaatacaatgatatgagactagtactagaagcaggagggtttgatattaaagccatagatttggaccacatagaagagatagcgtcccttataacactaaatacggaaagagaagcatttgaactatcactttcaaacgaaatagacaacaatctaaaacaatttcttgtagagaattttaatgctttaaggaaatgtaaacctaacaacagttggcattcattctcgaaagaaaacctacaaagactaatcactgagctcgaacacacttccgatgaacaaaacacaatactagaaagactgggactaaaattcgatctcagatcaaaatacagtgatagggatacacttcctatccatgaagtactcgaagagatatataatcccacagtatctaaatccgttagacaaacatttagagtattaaatgcacttgtaaaaaaatacggaaaagaaaacatagattacgttaccatcgaaatgccaagagataaaaacgaagatgatcaaaaaaaaacaatcagagaaattcaaaaagtgaacaaaaatagaaaagacaaaagcaaagaatatttcctaaagaaatcaggatggagcgaagaaaaattcgaagaaaaactcagaacaagccgacgtttcgcttccaaactctactacttctatgagcaagatggcctatgcgcttacaccggccaacaaatacaaccagaagacttattaactgaacgtgtagaagtggatcacatcattccattaagtgtaagcctagatgatagcataaacaacaaagttcttgtaacctccgaggcgaatcaaaaaaaaggacaaagaagtccttatgatgcattcatgagcggcgacttcagtaaatacagaacatacgatgaatacaaggcgtgggtactatcaaacaaatacaaaaaatataaaaaggcattattattagaagaaagaaacatatttgatccagagctagcaaaaaaatttagacagcgaaaccttaacgacacacgatatgcttcaagaatagtactcaatgcagtacaatcttttttttacaaaacagatacaaagaccagagtcgtaaacggagcattcactcatacactcagaaaaaaatggaacctagcagataaagacagagaaacacaccaccatcatgcaatagacgcaactttagttgcagtaacaccgtttgtaaaggcagaaagatacgaatactataaagatagtgaaggcaaagccagtatggtggatacagtcactggaacaataatcccatacagtgaatacaaaaaaaaaaatttatacgatagatctaattatttactcatgttcggtaatgaatccacaataaaccaagaaaaagaagacaaatcagcagagtttatcagaaacctcattccagcaaaaatttacccagaaataaaattttcccaccaagtcgacagaaaatcaaataggcgactatcagatgccacaatatatagtacacgttcttacacagtagaaaaaggtcgaggaaaaaataaaagagaagtaatagaaagagatataataggcaaaattaaagacatttatactgcagatggatatgctgaatatgtaaaatataaagactcacttctcgtaaaggaaatcgatgaaaaaacattcgagaaattagaagctataattgaagaattttcagataccgtagaagtaacagatcaacaaggcaaagtaaaaaaagtatcaaaatcaccatttctacagtattgcgaaaaatacgacgtaccaggtgtcaccaaatattcaaaaaaaaacaatggaccagtaataagatctctaaaataccgatataccaagctacgctcccatatagatatctcaccaaaaaacagcaagaacacagtggcgctattaacacttgcaccctggagaaccgacgtctattacagtcaagaaactgcatcctatcacttattaggattaaaatatattgatctatcatttagagacggcggctacggagtatctagaaagagatatgaagaaataaaaaagaacgaaaggatcccagaagacggagaatttaaatttagcttgtacaagaaggactacattgaaatcgaattcgacaaaaaaatattaccaggcctttatcaatcaagagatgttagtgccagaaacaaattcagcatgaaaccaatcgataaagcccaatggacaagcaaggaagatgtactcatgttcggaaacgtcaaagcttcaggagtattcgaaaaaacattaaaaaaaaactacgtcttacgaaagtaccacgttgatgtactaggtaacaagttcgaagtaaaggatgagatacttaaagatatactcgaatga

SEQ ID NO: 5169 - RNA, 3429 nt, synthetic construct
  misc_feature 1..3429: note = Cas9 variant
  source 1..3429: mol_type = other RNA
atgtatagcgtaggtctcgacatcggtatcgcgtcatgtggatactcaataatcaacgacgtaaacggaaatatcgttgaactaggaactctattatttaaatcacgaaactcagacaacaatgaagaaagaagaaccaacagaggatcccggagactcataaaccgtcgaagaaccagactcgacgatggaaagaaattactagcagaaaaaggattcaaacaagactctaaactaaaacacgtatgtccatacgagttaagagtaaaaggtttacacgagaaactcacccaaggagaaatctacaaagtagtactccatatcctaaagaaaagaggtatctcttacctagacgaatcggatgaaaactctagcgggatagatggtgcaagttacaaagatcaagtcaatctaaacctaaacttacaaaaagaattaacaccaggacaaattcaactcaaacgtctaaaagaaaacggcagaataaaaagcggagtaacatttgaaaatggttaccaactcaatgtcttcagtgtctccgcgtacgcaaacgagctgaataaaatacttacaaaacaatcagaatattactcagaaattgaccaaatttggatagaccgatttacgaaaaacgggtaccgtaaagaagctggactcgtttaccgcaaaaggccatattacgacggaccaggcaacgagaaaaacaacagcatttacggaagatgggccaactttaaagaagatggacacccgaaagaaaacatatttgatcagctcataggacttgattcagtagattccacacaagtaagagcatctgcatcaacattaacagcccaaaaatataacttactaaacgacctaaacaacctaacaattatagaagacgaccgaaaatttacaactgacgaaaaagtatcgataatcaactacttaatgacccaggatatcacacgattcggtcccaaagaactagcaaaattttaccagctagaagttgatcaaattcgtggttggagaatagacaacaaaggaaacccggaaatccattcattaaaagtatacagagattggaagaaaatattcaacacaagttcaatagacctaacaagtatacaaacttgggtggtagacgaattagcaaacgttataacattaaacacggaaatcccatccacattagccacactaaaaatcaaaataccagacatagatcaacaaattttaaattttgtagaaaacaacttctacgaactaaagaagaaaacaagcaaaaactcatggcattcgttctcacttaaaacattaaatatactaataccagaactcttaaacacaagcgaagaacagaatacgatattagaaagacttaacttaaaattcgatttgaaaaataaatatgcagaaaagaaccaaattcctgttaaagaattactagaacaaatttataatccaaccgttacaaaatccgtacaccaatctataaaactattcaatgaaataatagaaaaatacggtaaaaataatatttcatatgtaaccatcgaaatgccaagagacaaaaatgaccaagatcaaaaagatacaattaaacgaattaacaaactcaactcagaaagaaagaatgactccgaaaaatatttcttagaaagatcaggatgggacacaataagattcgaatcagccctaaagaaacctagattcgctgaaaaattactcttctactatgaacaaaaaggaaaatgtgcatacagtggacaggacatattagcagaatcactactaaacgaatcatgtgaagtcgaccacatcataccactatcaatatcgtttgacgactcgatccacaacaaagttcttgttacagcatcatcaaatcaagaaaaaggacaaagaaccccatacatggcctttatagatggagcaaaactaggtcaaagctgggatgatttcgttgcctgggtaaactcttgcggatttcatcgaaagaaagtacaaaacttactctacgaagaaaatatctttaacccagacgtacaaagaggattcgtttccagaaacttaaacgatacgaggtatgcaagcagaatagtactgaatgccatccaatctttcttctataaacaaaaagatctaacaaaagttaaagtagtaaacggatcattcacacatacactacgaaagaaatggggatcatcactggataaaaatagagacacttaccaccatcacgcagttgacgcgaccctgtgtgccgtaacgccctttattaacatcgtaaaatacgagttcttcgaagaagacggtataaaatacatggtagacctaacaacaggggaaaaagttgcgtactcagattacaagaaaatgaaattttatgacaaaagagcatacgtaccaatatgggatggatttatcaaacaactcacaccggctaacctataccccaaaataaaattttcacaccaagttgactcgaaatggaatagaaaaataagtgatgccacgatatatagtactcgcaaaatagtggaaacaaaaataaacaagaaaggagtagcaaaagaaactgtaaaagacatagtaatcgacaaaataaaagacatatatacaccagaaggatggagaaaattcaaagaaaaacaagataaactattaatgaaaaatttcgacgagaaaacatacaacaaattaatcaaaattgccaaagaataccccgaaaagaaagaagtacaaacatccaatggtaaagtcagcttagtagaagtatcaccatttaaaatgtattgcgaagaacaaaatgtaccagctattcgaaaatactcaaagaaaggaaatggcccatacatacggtcgctcaaattttatgataaagaattgggcaaacatataaacataaccaaagatagctacggaaacgatattgaacgtacaatacgcaacaagaaaatcatactcaaaaaccaaaattcctggcgaacagatgtgtactataattcagtaaataattgctatgaactgttaggcataaaatactgtcacctcaaattttatcgtggcaaatatggaatacccaaaagcatttacgacgaactaaagaaagaagatgaaatatcaagcgaatcagtttttaaattttccttatacagacacgatagagtaagattcgaaaaagacggagaatatatagaggctttattcggaagcaaaaacgaatcaaacaaaaactaccttgaactttcacctatagacaaaaacaaatggctatcaaaagaaaatgtaaaattcttcggagaagtagctgcctctggccgctttatcaaaggcttaaagcccggtataaaagtaataaagcaatcaacagactacatgggacatgtatatgcgatacaccaagaaaaattgaaattcgtactatcagacgcttga

SEQ ID NO: 5170 - RNA, 3435 nt, synthetic construct
  misc_feature 1..3435: note = Cas9 variant
  source 1..3435: mol_type = other RNA
atgacatctaaacaagaaaaacatggagcactaacatttggacttgatataggtatagcttcagtaggatgggcagttttaggggaatctagaatagtagatcttggagtaaggtgttttgacaaagctgaaactgcaaaagaaggtgaatcgttaaacttgacgcggagaatggcaagattactcagaaggagactacgaagacgagcttggagattaacgaaattagcgaggttattaaaacgagaaggtctaattgcggatgcaaacttatttaaacacaaaatagagaaaaacacccccgtccccaaatcatcttggcagctacgtgtagatggattggatagacaactaaacgcggaagaatgggcaagagttatctaccacttatgtaaacatagaggatttcattggatatctagagcagaagaaaaagcagctgaaggtgattctaagggtgaaggaggaaaagtaaaacaaggattagcagggacaaagaaattaatgcaagaaaaatcatatagaacagcagctgaaatggttttagctgaatttccagatgcacagcgcaataaacaaggagattacagtaaagcattatcgcgaatactactcggcgacgaattaaaggctttattcgaacatcaaagaaaactaggaaatccagtagcaaccgaaaaattggaagcagcaatattaggtaacggagataaaaagtgtgggctattttgggctcaaaacccagctttagcggggaataaattattagaaatgcttggtaggtgtacatttgaaaagacagggggcgatgatggcaaaggggaataccgagcaccgaaagcatctttttcggcagaaagacatgtttggctaacacacttaaacaatttaagaatcgtagtagacggaacaaccagaccactaaatgaagccgaaagacgtgtggctttgccgatgccttatcaacaagcaggcgatctttcgtacaaacaattgggaggcgcattaatcaaggaaggattcttgcagaaagatggctttaaatttgcaggtctaccatacccaactaagcaagcaagtgaagaaaaagcaaaagatccagaaacaagtgttttatgtaaactacccgcttggcatacattgcgcaaaactttagaaaagcatggattagaatcagaatggcagaaattatcgacagatgcgctagatggaaaacctcaattactagacaatatagcatgggtactttctgtttacaaagacgatgacgaagtaaaaactgaattgggaaaactaaatctacccaatacagaaaagatgattgatgctttactagatataaggtttgataaattttcaaatttaagccttaaagctctttcaaaaatcgttccatttatggaacagggacaacgatatgatgaggcagtagcaaatatccccgaatacgggcatcattcacaactacacaaagtaggtgcaggcgaacataaatatttgccaccattttataaagaaagagataaaacaggacgaatggtatttaacgatgacatggacatacctaggaatccagtagtactacgtgccctaaatcaagcacgcaaagtcgtaaatgcattaataaaagaatatggcagcccacacgaagtccatatagaaatggcaagggatctttcaaggccattagatgaaaggagagatatagaaaaacttcaaaaagaatttggtgagagaaacaagaaagacaaagaactattcgcacaagattttaatatagtcggtacagtaaaaggaaaacaattcgaaaaatatcaattgtatagagaacaacaggggaaatgcatatatccttcgatggacgaaaaacaaggaatatgctgttactcactaaaaccattagatctacatcgggtattgtacgaagaaggatacgcagaaatcgatcacgcattaccatattcaagatcatttgacgatagcaaaaataacagggtacttgtgctggcaaaagaaaatagggataaaggcaatagaacaccctttgaatatctaggcgataaagataactcagagccatggagacagtttgtagcatttgtcgaaggtaataaagcgtatagacttgcaaaacgatcaagacttctaagaaaagactttggagacaaagaagctaaagagtttagagaaagaaacctaaacgatacgaggtatatttgtaaattcttcaaaaattatgtagagcaatacttacaattacacgaagattcggaagcaaagagatgtgttgtattatcaggacagatgacctcattcctgagagcgcgttggggcctagtgaaagtaagaggagacagcgaccgacaccacgcgttagatgcagctgtagtcgccgcatgcagtcacggaatggtaaaacgtctgagtgattacagtcgaagaaaagagctggagcaagtaagggaaggctttgtagatgtagatacaggagaaatagtaaatccagcgatgttccaacaagttcaagaacatttcccaaatccgtggccacatttcagagacgaggtaaaactaagattaagcattgacgacccaactctattaaggtcagaaatggaaaaatttgggacatacacgccagaaagcctagaggctttaaggcccttatttgttagtcgagcaccgcaacgaagaaactcaggtgcagcccacaaagataccatatatgcacaaccaaaaaggctcgtagcacaaggaggtgtaacacaaaaagtggcactaagttcccttaccttaaaagacctggataaattaattgatccccatagaaacgaaaggctgtatgctgcgatacgagccagattagaacaacacggtggaaaaggtgacaaagccttccctgcctcaaatccattaagaaaaccagactcggaaggaaatccaacaggtcccatagttcgaggcgttacgatggtgattgataaacttagtggaatacctatcagaggaggaatagctaaaaacgatagcatggtgcgagtagatgttttcacaaaggcgaacaaatttcacttagtacccgtatacgtacatcactctgtgttgggactaccaaaccaagctattgtagggggaaaagaagaatcagaatggacgcaaatagacgacagttttgactggcatttcagcatctatcctaacgatttaatacgggttaccttaaagcaggaaggaaggttcggctattacgcaggatgtgacagaagtactgcagctatacatctgtgggcacatgatagaaaccaacaagtcggcaaagatgggttaataagaagtattggagttaaaacggcactctcaatagaaaaatttaatgtagatgtattaggaaaccggtacccagcacctccggagaaaaggcgagatttagcgtga

SEQ ID NO: 5171 - RNA, 3435 nt, synthetic construct
  misc_feature 1..3435: note = Cas9 variant
  source 1..3435: mol_type = other RNA
atgacctccaaacaagaaaacttgggggctctgacattcggactagacatagggattgcctcagtaggctgggcggtcctgggcgaaaatcgaattatagacctaggggttagatgttttgataaagccgaaacagcaaaagaaggtgaaagtctaaacctgacaagaagaatggcaagattactgagacgaagattaagaagaagggcatggagactcacaaaactagcacgtcttctaaaaagagaaggtttaatagcggacgctaatctatttaaacacaaaatagagaaaaatacgcccgtaccaaaaagtagttggcaactacgagtagatggcttagatcgacaacttaacgcagaggaatgggccagagtaatatatcatctatgtaaacaccgaggatttcattggatatctcgagctgaagaaaaagccgcagaaggagatagtaagggagaaggaggaaaagttaaacaaggattagctggcacaaagaaattaatgcaggaaaaatcctatagaacagcggctgaaatggttctagcagagttcccagacgcacaaagaaataaacaaggagattacagcaaagcattatctagaatactgctaggtgatgaacttaaagctctttttgaacatcaaagaaagctaggaaacccagtagctactgaaaaattggaagctgcaatactaggaaatggcgataagaaatgtggattattttgggcgcaaaatccggcactagcaggaaataaactattagaaatgttgggtcgatgcacgtttgagaaaactggtggagatgatggtaaaggcgaatatcgagctccaaaagcatcatttagtgccgaaaggcatgtctggctaacacatttgaataacttaagaatagtagtcgacgggactacaagacctctaaacgaagcagaaagaagggtagcattaccaatgccatatcaacaggctggcgatctatcatataaacaacttggaggagcattgataaaagagggatttctacaaaaagatggattcaaattcgcaggattaccatatccaactaaacaagcctcagaggaaaaagcaaaggatccagaaacaagtgttctgtgtaaactaccagcatggcatacacttagaaaaacactagagaaacacggtctggaaagcgaatggcaaaaactatcaacagatgcactagatggtaagccacaactattagacaatatagcatgggtgttgagtgtctacaaagatgatgatgaagtaaagacagaacttggaaaattaaatctccccaataccgagaaaatgatagacgcattattagatattcgctttgataaatttagtaacctaagtttaaaagcattatctaaaatagttccatttatggaacaaggtcaaaggtatgacgaagcggtagcaaacatcccagaatacggtcaccatagtcaactacataaagttggagcgggagaacacaaatacctcccaccattttataaagaacgggacaaaacaggtagaatggtattcaatgatgacatggacattccacggaatcctgtcgtattaagagcactaaatcaagcaagaaaagtagtaaatgcacttattaaagagtatggtagtcctcatgaagtacacatagaaatggcacgcgacttatcaagacccctagatgaacgtcgagatatcgaaaaacttcaaaaagaatttggagaaaggaataaaaaggacaaagaattatttgcgcaagactttaacatagttggaacagtcaaaggaaaacaatttgaaaaatatcagctttatcgcgaacaacaaggaaagtgtatttatccaagtatggatgaaaaacagggaatatgttgctacagcctgaaaccattggaccttcatagagtcttatatgaggagggatacgccgagatagatcatgcgttaccctacagtagaagttttgatgattccaaaaacaacagagtattggtcttggcaaaagaaaacagagataaagggaatcgaacaccctttgaataccttggagataaggataactcagaaccatggcggcaatttgttgcatttgtagaaggtaacaaagcctatcgacttgccaaaaggtccagattactacgaaaggactttggagataaagaagcaaaagagttcagagaacgaaacctaaatgatacccgttacatatgcaaattctttaaaaactatgtagaacaatatttacaattacatgaagacagtgaagcgaaaagatgtgttgttctaagtggacaaatgacatcttttcttagagctcgatggggcctagtaaaagtacggggagatagtgacaggcaccacgcattagacgctgcagttgtagcagcttgctcacacggaatggtaaaacgattgtcagactattctagaagaaaagaactagaacaagtcagagaaggatttgtagatgtcgacaccggagaaatagtcaatccagctatgtttcaacaagtgcaagaacactttccaaacccgtggccacactttagggacgaagtaaaactacggctaagtatagatgacccaacactactaagatcagaaatggaaaaattcggaacatacacaccggaaagtttagaagccctaagaccactttttgtatctcgagcaccacaaagaagaaactcaggcgctgcccacaaagacactatttatgctcaaccaaaaagacttgtagcacaaggaggggtaacacaaaaagtggctttatcttccttgacactaaaagatcttgataaattaatagacccacatagaaatgaaagattatacgccgcaattagagcacgactcgaacaacacggaggtaaaggagataaagcattcccagcgtcgaatccattaagaaaaccagacagcgaaggaaatcctaccggacccatagtaagaggagttacaatggtgatagacaaattaagtggaataccgattagaggagggattgctaaaaatgacagtatggtaagagtagacgtattcaccaaagccaataaatttcaccttgtacccgtgtacgtacatcattcagtattgggtctacctaatcaagctatagtaggaggaaaagaagaatcagaatggacacagatcgacgacagtttcgattggcactttagtatatacccaaacgatttaatccgagtaacacttaaacaagaaggccgttttgggtattatgcaggatgtgatagatcaacagccgcaatccacctatgggcacatgatagaaatcaacaagtaggaaaagatggtctaataagatcaataggtgttaaaaccgcactgagcatagaaaaattcaacgtagatgtgttaggaaatagatatccagcgccacccgagaaaagaagagacttagcctga

SEQ ID NO: 5172 - RNA, 3438 nt, synthetic construct
  misc_feature 1..3438: note = Cas9 variant
  source 1..3438: mol_type = other RNA
atgaaaactatattgggtctcgacctaggaacaaattcaataggttgggcattagtcaaagaaacagaaaacagcaatgaaaaatcagaaatcataaaacttggtgtaagggtaaatcccttaacagtcgacgagaaaactaatttcgaagcaggtcgcccgttatctacaaatgcagacagaacggccaaacgctcagctcgacgcaaccttcaacgatataaactcagacgcaaaaatttaatagatctcctaataaaacatcgattaatagataaagataccccacttacagaaattggcaaaaacacgacacaccaaactctagaattacgtgcgaaagccgcccgagaacgaatagaattggaagacctagccagggttttcctagcaattaacaagaaaaggggataccggagctcaagaaaagtaaacaacgaagaagaaggacaagtagtagacggaatggccgtagccaagaaattatacgacgaaaatctaactccaggccaatacgcctacgaattactttcaaaagggaagaaatacgtacccgatttttaccgaagtgacctacaagctgaatttgactcaatatgggaataccaaaaacaattttatgcagacattcttgacgatgaactttataatgccctaaaagggcaaggacaacaaaatagccgtaaacgcttcctagcaataaaaggtgtatatacagcggaaaacaaaggaaaacgcgatgaagtcaaacttcaacactacaaatggagatcagaagcaataacacaaaaactaagcatagaagaagtagcttacgtcttagtagaaataaacaacgacctaaacaaaagtagcggttacttgggagcaatttccgatagatctaaagaattgtactttaataaagaaacagttggagaaaacctatggaaacaaatccagaaaaacccacacacaagcctaaagaatcaagtattttacaggcaagattacttagacgaatttgaacaaatatgggaaacacaagcacaatttcatccccaactaacgttagctctaaaagaacaaatccgagatgtagtaatattctaccaacggaaattaaaaagccaaaaaggactgttgagcttttgccaattcgaaagctgggaaattgaaagaaaagatgaaaatggaaacgtcatactaaataaaacaacacaattaccaaaaagacaaacggttggacgacgagtcgcacccaaatcatctcctctctttcaagaatttaaaatatggcaaaacataaataacctggagatagctaaaataagtgacggaaactctaaaaacaagaaagaaacagaagccctatcagatgacgaaagaaaactactattcgaagaactcaacttacgaggcaacctaagccaaaaagaagtccttcaaatattaggtctaaaagacaaagaatataaaacaaacttccccgaaggactcgaaggaaatagaacaaacgcagcattgttcaacatctatcaacaaatagcagaaaatgaaggatacggagattggacgaaaaagtcagctcaagagattaaggaagaactaaaggctgtattccctcaaataggaatacaagccgacatactagacttcaatgcagaactggacggaaaagagttcgagaaccaagcgtcatatcaactatggcacctcttatactcagcagaagaggatgacaaaataaacgaagaagatcagataatatacggcaactcagccgtatcactcaaaaagaaactatgtgaaaaattcggatttacacccgaatacgcgaaatggatcgcaaatgtatccctacaagacgattacggaaacctatcaacaaaagcaatgcgaaaaatcatcccctacttaatagacggaaacgattactctgaagcctgtgcactcgcaggctataatcactcgaactcgctcactaaagaagaaaatgacaacagggaaagactaaataaactagaactactacccaaaaacagtcttcgaaatccagtagtagagaaaatattaaatcaaatggtaaacgtggttaatcaagtcatcgaaacctatggaaaaccagatgaagttagaatagaattagctagagaattaaagaaatccgctgaagaaagagccgaaatgactaaaggtataaatgaagcaacacgccgaaatgaagacataaagaaactcatcaccaaaaacttcggcatcccaaaccccaccaaaaacgacgttgtaagatatcgactttgggaagagttagcgcccctagcctataaagatgtttttacaggccgtcaaatcaagaaagaggaccttttctcatccaaaattgacatagaacatataataccaaaagcactactattcgatgactccttttcaaataaaacattagccttcagagaaaccaacctaaagaaagcagaccggacagcctacggatttatagaaagcgattataacgcaacattagacgactacatacaaagagttgaaacattatacaataatgctaaaggaacaatatcaaaagggaaacgaaacaaacttctaatggcgcagaaaaacctcccagacggatttatagaaagagatttaagaaatagtcaatacatcgcaaagaaagcaaaatctatgatagaaaaagtatttaatgacgtaaacgtaaccagtggaagtataacagatcggttaagagaagactgggacctgataaatgtcatgaaagaacttaacttcccaaaatacaaagcattaggtctaacggaaatagaggaacgttacgatataggacaagagaaaaccaagaaagtagaagtcattacagactggacaaaacgcaacgatcacaggcaccacgctatggatgcattaacagtcgctttcacaacaaaaagccatgtacaatatctaaataacttaaatactattcattctttaaaaggcgatgaagtagatttagaactctcaaaactatacggccttaaaaatactatcaccgaagtagtaaataagaaacgaaaatttattcctcccatgcccaattttagagaagaggcgaagaaacacattgaaaccatattagtatccatcaaaaataaaaacaaagtatataccaaaaacataaataaaactaagaaagaaagcggatatcacacaaaagaacaattaacacccagaggacaattacacaaagaaacagtttacggaaaatccaaaagaccaatgaacaaacctacaaaaataaacaaaaatttctctctagaacaagcccaacttataataaatgttcaagaaaaagagctagttctgcgacacttagcccaattcgataataatccagcagtcgcctttgacaccaaaactctgaagaaatgtcactacctaaaaatggtaaatctttga

SEQ ID NO: 5173 - RNA, 3441 nt, synthetic construct
  misc_feature 1..3441: note = Cas9 variant
  source 1..3441: mol_type = other RNA
atgtcaggaaatacacatggtcctcttacgtttggattcgatattgggattgcatcagtaggatggtgcgtcctaggggaaaaccggatagtaaatttgggagtcaggtgtttcgataaagcggaaaccgcgaaagaaggcgaatctctaaatcttgcgagacgaacagcaagattgatgagaaggcgacttagaaggagagcttggagattaaccaaattagcacgactactgaaaagggaaggattaatagcagaagcatcaaggatacacatcccatcgcctgttagcccatggagactaagggtagaaggcatagacaggcgtctaactgacgatgaatgggcacgtgtaatttaccatttatgtaaacatcgaggttttcattggataagtcgggcggaggaaagaaaagcagaaagcgatgctaaagaaggaggaagggtaaagaaaggattatcagatactcaaagaagaatgacagaaaaaggttataggagtgctgctgaaatggtacttgcggaatttcctgatgctcaacgaaataaacaaggagactatggaaaagcattaagtcgaatccttttatcagatgaattagctttgcttttccgaaggcaaagagaattaggaaacccaaatgctggtaacgaacttgaagccaccattttaggaaatgggaacaggaaaagtggattattttgggaacaaaaaccacctctagctggtgcagatctgttaaaaatgctaggcagatgtacattcgaaaagaatgaataccgagcaccaaaggcttcatttacagcggaacgacacgtatggcttacgagattaaacaacttaagagttgttgtggatggaacaactagatccctcgacgatgcagaacatagattagttctaccattaccttacaaacaagccggcgattttacatacaaacaattaagaactgcattaacgaaagctggattattacccgaaggattcaaattcgcaggattaagttacccaacaggacgtcaattagatgatccgaaagccaaagacccagaaagtgaaaaattagtcaggctaccagcatggcaggaacttagaaaaacactcaaagataaaaatctagaaacagaatgggaagggatggcgggtgcagccacaggaggaaacccagaacttcttgatgaaatcgcacgagttctgagtgtattcaaagatggagatgaggtaacagcggaactctggaaattaccactaccaggaggaaaggctatgatagatgcgttatctgaaataagttttgataaatttcatgcattatcattaaaagccctcagaaaaatagtaccccatatggaatcgggcctacgatacgatgaggcatgtgcagtggcaggttatcatcatagccagttacacgctgccggagctggagaacacaaatttctgccgcccttctattcaagacgagataaagatggacgaatggtctttaatgaagaattagatgtaccccgaaatcctgttgttctacgagcgttaaaccaagcgaggaaagtattgaacgccctagtacggacctatggctcacctacagctgtacacattgaaatggcaagagatctatctagacccctggatgaaagaaacaaagtaaagaaagctcaagatgaataccgcgaacgtaacgaaaaagataaagctgcatttgcagctgaatatggtattgcccctaaatctcgagaatttgaaaaatttcaactatacagagagcaacaaggaaaatgtgcatattctttaaaaagcctagatctgcatagagtcctgcacgacatcggatatgcagaagtagatcacgctctaccgtatagtcgatcatacgacgatagcaaaaacaataaagtactagcgttaacggaagaaaatagaaataaaggaaatagaacagcttacgaatacttaacctcatttccaggcggagaaaatggagaaagatggagaaattttagtgttgccgttgaaacaaataaagcatacagactagcaaaaaggacacgattattaagaaaagatttcagtggcagagcagcagaagaatttagagaacgcaatcttaatgacacaagatacatctgccgattctttaaaaacacagttgaacggtttctaaaattagatgcaaaagtaggagcaggagatacagcagaaattagtgcaaaaaggtgcgtagtactgagtggacaaaccacagcatttttaagagctagatggggattactaaaggtaagaggtaatagtgacagacaccatgcattagatgctgcggtagtagcagcgtgttcacatggtatggtaaagagattaggtgattatagtaggactaaggaattagctaaagtccatgatggatttccagacccagagacaggagaaataatagatcccgtgatgtttcaacaacttcatgcgcatttcccagatccctggccgcattttcgggcggaacttgaggctagactaaacgtcgatgatacagccgatttaagagcacgaatggaattatttggcacatacgcccctgaagctcttgaaaccttacgacctttatttgtaagcagagccccacagaggcgaaattcaggtgcagcccataaagacacgatttatgctcaacccgaaagattaaaagaacaagggggtgtaacacaaaaagttccactcacctcgttaacattaaaagatttagataaattaatagaccctcacagaaacgaaaaactttatgccgcaatcagggccaggttagaagcacatggaggaaaagcagataaagcatttcccgcaggcaaccctttgcgaaaacctgatcgcgaaggaaatcccactggtccagtagtacgaactgtaactatggtcatagataaactatccggcatccctgtaagaggtggtatagctaaaaatgacacaatgttaagagttgatatctttagacacaagaaagatggcaaatttcatttggtaccagtatatgtctatcacgcagttgcaaaagaatttccaaatcgggccattgtacaagctaaagatgaagatgaatggacattaatcgatgacaaatttgatttttgtttctctgcgcatccaaacgacctgctaaagataacacagaaatctggagaaacaatattcgggtattaccgaggatgtcactcagggaccgctgcaataaatatagcactacatgatagatatgcatatgccgagaaaacaacaagtttggcattctcgaaaaagaaccctggaaaaccgatacctaatgacaaacttggcttaatagaaggcattggtgtaaaaatggctgccaatatggaaaagtttcatgtagatacattaggaaatatatatccagcaccaccagaacaaagacgtgggctagcatga

SEQ ID NO: 5174 - RNA, 3441 nt, synthetic construct
  misc_feature 1..3441: note = Cas9 variant
  source 1..3441: mol_type = other RNA
atggcgtacagacttggtctcgatattggaatcacaagtgtaggctgggccgtcgtcgctttagagaaagacgaatcaggacttaaacctgttagaatacaagacctaggcgtgagaattttcgataaagcagaggactcaaaaacaggagcatcactggcactcccaagacgagaggcaagaagcgcaagacgaaggactcgcaggaggcgccatcgactatggagagtgaaacgtttactagaacaacatggaatattaagcatggaacaaatagaagcactatatgcacaacgtacatcatcaccagatgtctacgcactaagagtagcgggactggaccgatgtttaatcgcagaagaaatagcgagagtattaatacacattgcacacagaagaggctttcaaagtaatcgaaaaagtgaaataaaagacagcgatgcaggaaaactgcttaaggctgtgcaagaaaatgagaacctaatgcaaagtaaaggttatcgaactgttgcagaaatgctagtatcagaagcaacaaaaaccgatgcagaagggaagttagtgcatggaaagaaacatggttatgtatcaaatgtacgaaataaagcgggtgagtacagacacacagtaagtaggcaagcaatagtggacgaagtaagaaaaatttttgcagcacaacgagctttaggtaacgacgttatgtcggaagaactagaagatagctatttaaaaattctgtgctctcaaagaaatttcgatgacggtccaggaggggatagcccatatggacacggatcagtatcaccggacggagtacgacaatcaatttatgaacgaatggtaggatcgtgtacattcgaaactggcgagaaaagagcaccccgttcaagttattcgtttgaaagatttcaactactaacaaaagtggtaaacctacgaatctatagacaacaagaagatggcgggaggtacccatgcgaattaacacagacagaaagagcaagagtcatagattgcgcttatgagcaaactaaaataacctatgggaaattaagaaaactactagatatgaaagacacagaaagttttgcaggactgacttatggactaaataggtctagaaataaaacagaagatactgttttcgtagaaatgaaattttatcacgaagttcgcaaagcgttacagagagctggagttttcatacaagacctatctatcgaaacgttagatcaaattggctggatactatcagtatggaaaagcgacgataacagaagaaagaaacttagtacactaggactatcagataacgtaatcgaagaactactccccttaaacggaagcaaatttggacatctttcattaaaagcaataaggaaaatactaccctttctggaggatggctattcttatgacgtagcatgcgaactagcaggttaccaattccaaggtaaaacagagtatgtaaaacaacgacttttgccacccctcggagaaggagaagttacaaacccagtagtaagacgagctctatcacaagccatcaaagtcgtcaatgctgtaattagaaaacacggctcaccggagagtatacacattgaactggcacgtgaattgagtaaaaatctagatgaaaggagaaaaattgaaaaagcgcaaaaagaaaaccagaaaaataatgaacaaattaaagacgaaattagagaaatcttgggatcagcacacgtaactggaagagatatagttaaatataaattatttaaacaacaacaagaattttgcatgtattcaggagaaaaactagacgttactcgactgtttgagcccggatatgcggaagtagatcacatcattccatatgggataagttttgatgactcttatgataataaagttctagtaaaaacagaacaaaataggcaaaaaggaaacagaactcctttagaatatctccgagataaacctgaacaaaaagcgaaatttatagcattggtcgagagcatacccctatcacagaaaaagaaaaatcatctattaatggataaaagagccatagatctagaacaggaaggattcagagaaagaaacctatcagatactcgatatataacccgagcgctcatgaaccacatacaagcctggctactattcgacgaaactgcctcaacaagaagcaaaagggtagtttgcgttaatggtgccgttacagcatatatgagagcaaggtggggcttgaccaaagatcgggatgctggagataaacatcacgctgcggatgcagtcgtcgtagcatgtataggggattcgttaattcaaagagtcacaaaatacgacaaattcaaaagaaatgccttagcagatagaaatcgatacgtacaacaagtaagtaaatcagaaggcattacacaatatgtggataaagaaacaggagaagtatttacatgggaatcctttgatgaaagaaaatttctcccaaacgaacctttagaaccctggcctttctttcgagacgaattattagcaaggttaagcgatgatccatctaaaaacattagagctataggactgttaacttattctgagacagaacaaatagatcctatatttgttagcagaatgcctacgagaaaagtaactggcgcagcccacaaagaaacaataagaagtcccagaatagtaaaagtagacgacaataaaggcaccgaaatacaagtagtagtatcaaaagttgccttaacagaacttaaacttacaaaagacggagaaattaaagattattttagaccagaagatgatccaagactttataataccctacgagaaagattagttcaatttggaggagacgcaaaagcagcatttaaagaaccggtatataaaataagtaaagatggttcagtaagaacacctgtacggaaagtaaaaatacaagaaaaactaactttaggcgtcccagtacatggaggtcgtggtattgcagaaaatggtggaatggtgagaatagacgtatttgctaaaggcggcaaatactattttgtaccaatttatgtagcggatgtgttaaaacgtgaattacctaaccgcctcgcgacagcacacaaaccatatagcgaatggagagtagtcgacgactcttaccaatttaaattcagtctatatccaaatgatgcagtcatgattaaaccaagtagagaagtagatataacatacaaggacagaaaagaaccagtaggttgcagaataatgtatttcgtatcagcaaatatagcgtcagcaagtattagcttaagaacccatgataattcaggagaattagaaggattagggatacaaggactagaggtattcgaaaaatatgtagtagggcccttaggcgacactcacccagtttataaagaaagaagaatgccctttagggtagaaagaaaaatgaactga

SEQ ID NO: 5175 - RNA, 3441 nt, synthetic construct
  misc_feature 1..3441: note = Cas9 variant
  source 1..3441: mol_type = other RNA
atggcatacaggttaggtctagatattggaattacatcagtaggatgggcggtggtagcattagaaaaagacgaatcgggactgaaacccgtgagaatacaagatctgggagtacgaattttcgacaaagctgaggacagtaagaccggagcgtcgctagcactacctcgtagagaagctcgtagcgcaagaagacgtacgcgaagaagaagacatagactatggcgagtgaaaaggttattagaacagcacggaatattatcaatggaacagattgaggctctatacgcacaacgaacaagctcaccagatgtctacgcattaagagtagccggccttgacagatgtttaatagccgaagaaattgcacgtgttttgatacacatagcacaccgaagaggatttcaaagtaatagaaaatcagaaattaaagacagcgatgcaggtaaattgttaaaggccgtacaagaaaacgagaatctcatgcaatcaaaaggatacagaacagtagctgaaatgctagtatctgaagcaacgaaaacagacgcggaaggtaaattggttcatggaaagaaacacggatatgtaagtaacgtgcggaataaagctggagaatatagacatacagtatcaagacaggcaatcgtagatgaagtacgaaaaatctttgccgcacaacgagctttaggtaatgacgtaatgtccgaggaactagaagactcatatcttaaaatcttatgcagtcaaagaaatttcgatgatggaccaggaggagattcaccctatggccatggctctgtatcaccggatggagtacgtcaatcgatttacgaaagaatggtaggatcatgtacattcgaaacaggagagaaaagagcaccacgaagttcatacagcttcgaaagattccaattgttaacgaaagtagttaatttacgaatctacagacaacaagaggacggaggcagatatccatgcgaacttacccaaaccgagcgagcacgagtaatcgattgtgcttacgaacaaactaaaataacatacggtaaactcagaaaactactagacatgaaggatacagaaagttttgcaggtctcacctacggactaaataggagcagaaacaagacggaagacacagtctttgtagaaatgaaattttatcacgaagttagaaaagccttgcaaagagcaggagtttttatacaagacttgagcatagaaactctcgatcaaatcggatggatcttgagtgtatggaaatcagacgacaaccgaaggaagaaactaagcacattaggtttatccgacaacgtaatcgaagaattacttccattaaacggttccaaatttggacacctcagccttaaagccataagaaaaattttaccatttttagaagacggatactcatacgacgtagcttgtgaacttgcaggataccaattccagggaaaaacagaatacgttaaacaaaggttgctacctcctctaggagaaggcgaagtaacaaatccagtagttagacgagcactaagccaagcgataaaagtagttaatgcagtaatacgaaaacatggaagtcctgagtctatacatattgagttagcaagagaactaagtaaaaacttggacgaacgccgaaaaatagaaaaagctcaaaaagaaaatcagaaaaacaatgaacaaataaaagatgaaataagagaaattcttggatcggctcacgtaaccgggagagatattgtaaaatataaactattcaaacaacaacaggaattttgtatgtactcaggcgaaaaattagacgtcacaaggttatttgaacctggctacgcagaagtggaccatataataccttatggcataagttttgacgatagttacgataataaagttctagtaaaaactgaacaaaatagacaaaaaggtaacagaacaccattagaatatttacgagataaacctgagcaaaaagcaaagttcatagcacttgtagaatctatacccttaagtcaaaagaagaaaaaccatctattaatggataaacgagccatagatctagaacaagaaggctttcgtgagagaaacttaagcgatactagatacattacacgagcattaatgaatcatattcaagcatggcttttatttgatgaaacagcctcgacacgatcaaaaagagtagtatgcgtaaacggtgcggttacagcatacatgagagcaagatggggattaaccaaagacagaaacgctggggataaacaccatgcagcagacgccgtcgtggtggcatgcataggagattccctaatacaaagagtaactaaatatgacaaatttaaaagaaatgcattagcagatagaaacagatatgtacaacaggtctcaaaatctgaaggtataacgcaatatgttgataaagaaaccggagaagtatttacatgggaatcattcgatgaaagaaaattcttaccaaatgaaccattagaaccatggcctttcttcagagacgaattattagcacgtttatcagatgatccttcgaaaaacatacgcgctatagggttattaacgtattcagaaacagaacaaatagatcctatattcgtatctcgaatgccgacgcggaaggtaaccggtgcagctcataaagagacaattagaagtcctcgaatagtcaaagtagacgataataaaggaacagaaattcaagtagttgtatctaaggtagcattaaccgaactcaaactaacgaaagatggggaaattaaggattactttagaccagaagatgatccacgactctataatacgctcagagaaaggcttgttcaattcggaggagacgcaaaggctgcatttaaagaaccagtctataaaatttcgaaagatggaagtgtcaggacgccagtaagaaaagttaaaatacaagaaaagttaacattaggagtacctgttcacggaggaagaggtatagcagaaaatgggggtatggttcgcatcgatgtgtttgcaaaagatggtaaatattattttgtgccaatttatgtagcagatgtactaaagagggaactaccaaatcgcttagctacagcacataaaccctacagcgaatggagagtagtcgacgattcatatcaatttaaattttcattatatccgaatgacgcagttatgatcaaaccctcaagggaagtagatataacgtataaagacaggaaagaacctgtagggcttagattaatgtattttgctggtgctgacatatcaggagcaaccctgacgctccgaactcatgacaattctggagaattaaaaggcttaggcattcaaggactcgaagtattcgaaaagtacgttgtaggacctttaggggacacacacccagtttataaagagcgccgaatgccattcagagtagagagaaaaatgaactga

SEQ ID NO: 5176 - RNA, 3447 nt, synthetic construct
  misc_feature 1..3447: note = Cas9 variant
  source 1..3447: mol_type = other RNA
atgacaaaattaaatcaaccatatggaataggactagacattggatcaaactctatcggatttgccgtggtagatgcaaactcccacctactaagacttaaaggcgaaaccgcaataggagctagactctttcgcgaaggacaatcagcagcagaccgccgcggctcgagaacaaccagacgtagattatctcgcacaagatggcgactatcattcttaagagactttttcgcaccacacattacaaaaatagatcctgactttttcttacgccaaaaatatagcgaaatttcccctaaagataaagacagattcaaatatgagaaaagattattcaacgatagaacagatgcagagttctacgaagcatacccatccatgtatcaccttcgactacgactaatgactgacgcctcacaagcagatcccagagaaatctttctagcgattcatcacatactcaaatcacgaggacactttctaacacctggcgctgctaaagactttaacacagacaaagtcgatttagaagacatattcccagcattaacagaagcatacgcacaagtttatcctgacctggaattgacatttgatctagccaaagcagacgactttaaggcaaaactactagatgaacaagccacaccatccgacacacaaaaggctttagtaaatctactcctaagctccgatggagaaaaagaaatagttaaaaagagaaaacaggtactgacagaatttgcaaaggccatcacaggactaaagaccaaattcaacttggcactaggaaccgaagtagatgaagcggatgcatcaaactggcaattctcaatgggacaattagatgataagtggtcaaacatagaaacatctatgacagaccaaggcacagaaatcttcgaacaaatacaagaactttatagagcgagattacttaacggaatcgtacctgcaggcatgtcactttcacaagcaaaagtagcagattatggacaacacaacgaagatctagaactattcaaaacgtacctaaagaaactaaacgaccatgaactcgcgaaaacaataagagtcatatacgaccgatacataaatggagacgacgctaaaccctttttacgagaagactttgtaaaagcattgaccaaagaagtaacagctcaccccaatgaagtgtcagaacaattattaaacagaatgggacaagcaaatttcatgcttaaacaacgtacaaaagccaatggagcgatacccgtacaactgcaacaacgagaattagatcaaataatagcaaatcaaagtaaatattatgactggctagctaaaccaaaccctgttgaaaaacatcgcgcaagtaaaccatatcagctcgatgaactcctaacatttaggattccctattacgtaggacctttaataacacctaaagaacaagccaaatccggagaaaatgtattcgcgtggatggtaagaaaagacccctcagggaacataactccatataatttcgatgaaaaagtagatagagaagcatcagctaacgtttttatccaaagaatgaaaaccacagacacatatttaataggagaagatgtccttccaaaacaatctctactgtaccagaaatatgaggtcttaaatgaattgaacaacgtacgggtaaacaatgaagcattaggtactgaccagaaacaaagactcattagagaagtcttcgaaagacactcctctgtcacaataaaacaagtagctgataatctagttgcacatggagattttgcacaaagaccagaaatacgcggccttgcagacgagaaaagattcttatcatctttaagtacatatcatcaattaaaggaaatactacatggcgcaatagatgattcaacaaaacttcacgatatagaaaacataataacatggtcaaccgtattcgaagacgcagcaatatttaaaaccaaattagctgaaatagactggctagacgccgccacaattaagaaactttcaaacattaggtacaggggatggggtcagttctcacgaaaactcttagacggattaaaactaggcaatggacaaacagtaatacaagaactcatgttatcaaatcacaatctaatgcaaatactaactgacgaaacattgaaaactacaatggcggaactcaaccaggataaattaaaagccgatgatatagaagatgtaattaacgatgcatacacatcaccatccaacaagaaagcactaagacaagttcttagagtagtagaagacataaaacacgccgctaatggccaagacccttcatggctatacatagaaacagctgacggcccaggaacagcaggaaaaagaactcaatcaagacagaaacaaattcagacagtctatgcaaatgcggcacaagaattaatagattcagcagttagaggagaactagaggacaaaatagcagacaaagcctcattcacagacagattagtattatactttatgcaaggaggaagagacatctacacaggcgcaccactaaacatagatcaactctcacattacgacatagatcatatccttcctcaaagtcttattaaagacgatagtctggacaacagagttctcgtcaacgccacaataaatcgagagaaaaacaacgtattcacctcaaccttattcgcaagcaaaatggctgcaacctggcgaaagtggcatgaagcaggacttatatcaggtcgaaaattacgaaacctaatgctacgtcccgacgaaatagacaagtttgcacacggatttgtagctagacagttagtagaaacgagacaaattattaaactaacagaacaaatagcagcagcccaataccctaatacaaaaataatagcagtcaaagctggtctatcacaccaattaagagaagaactggactttcccaaaaaccgagatgttaaccattaccaccatgcatttgatgcattcctagctgcccgaatagggacatacctcctcaaacgatatgcaaaactagccccattcttcacttacggtgagttcgcaaaggtagacgtaaagaaattccgagaatttaattttattggagctcttaaacacgctaagaaaaatatagtcgcgaaagacactggtgaaatagtatgggataaagaacgtgacatacaagaactagatagaatatacaatttcaaaagaatgcttattacccacgaagtctatttcgaaacggcagacctcttcaaacaaactatatatgcagcaaaagattccaaagaaagaggtggctcaaaacaactaatcccaaagaaacgaggttatccaacacaagtatatggtggcatacacggtaaaataagactaacatggagatggctaaaactcctaagacgaaagaaaatgtcaatagaattatctgaattacaactacttaaatga

SEQ ID NO: 5177 - RNA, 3450 nt, synthetic construct
  misc_feature 1..3450: note = Cas9 variant
  source 1..3450: mol_type = other RNA
atggaaagataccacataggactcgacataggaacatcatcaataggctgggcagttataggagacgacttcaaaataaaacgtaagaaaggtaaaaatctaataggcgtacgactatttaaagaaggagataccgcggcagaaagaagaggattccgaactcagaggagacgcctaaacaggcgaaaatggcgattgaaactgttggaagaaattttcgacccttatatggcagaagtagataaatactttttcgcgaggttaaaagagtcaaacctctcgccgaaagattcaaataagaaatacttgggtagtctactatttccggacatatcagattcaaacttttacgataaatacccaacgatataccatctgcgacgcgatctcatggaaaaagacaagaaatttgacctacgagaaatctatttagcaatccaccatatagtaaaataccgcggaaattttctcgaaaaagtaccagccaaaaactacaaaaactccggagcaagcataggattcctactagaagaagtaaacgacttgtacggaaatataattggtaatgaagatgtagcaatactcgacaatgacaaatttgaagacgtagagaaaatcatactaaatgacgaaataagaaacatagataaacagaaaaatgtaggaagattactcgtgaaagacaagaaagagaaaaacatagttacagcattctccaaagccatatttggatacaaatttaatttagaagacttactactaatcgaatcagatgagaaaaataaattaacattcaacgatgaaaacatagatgatatcttcaacgaactatctcattcattaaatgacaaccaaatggacctactaactaaaacaagagaaatctatttcaaatttaaattgaacatgatagtaccaacaggatacaccatctccgaaagcatgattgaaaaatacgaaatgcataaagcacaccttaaaatgtataaagaatttataaacacattaaacgcaaaagataggaaaatacttaaaaatgcatatagcgactacataaataatgaaaaagcaaaagcagcaaatgctcaagaaaacttctacaaaaccgtcaagaaaacaataaaagaaaatgattcagatacagccaagaaaataatcggcttaatagacgaaggaaatttcatgccgaaacaaagaacaggggaaaacggtgtgataccacaccaattacatcaaattgaattagatcgaataatagaaaatcaagccaaatactacccttggctggcagaagaaaacccagtagagaaaaataggaaattcgcaaaatataaattagatgaactcgtgacattcagagtaccatactatgtaggacccctcatagacaaaactgaatccaataaaaacgaaaaagaaacaaaattcgcctggatggtgagaaaagcaaaaggaacaatcaccccttggaacttcgaaaatctagtagacaggacagaaagcgcaaacagattcataaaaaggatgacatcaaaagacacctatataataggcgaagatgtactacccgcaagcagtttactatacgaaaaatataaagtactcaacgaattaaacaacatcaaagtaaacaaaaagaaactagacgtagaacaaaaacaacacgtctacctagacttattcactacccgcaaaaacgtcacgaaagacgatctagccacatcattaaactgtgatgtagaatcaataacaggtctaacagataataagaaattcaactcgagtttaagtagttatatagacctcaaagcaatactaggaaacatcgtggatgactatagcaaaaatgaagacttagagaaaataatagaatactccacaatattcgaagacggaaacatctataaagaaaaactatccgaaatctcatggttaacagacgaacaaatcgaaaaactatcaaacattcacttcaaaggatggggaagactatccaagaaactattaacacaaataacaaacgaaaacggcgaaaggattatagacacactctggaataccagtaacaacttcatacaagtaatatctgacgaaagcatccaagcaaaactagcagaaataaacggggaatacgcgaacaaatacaacttggaagatatactcgatgaagcctacacatcacctcaaaacaagaaagcaataagacaagtcatgaaagtagtagaagacattgaaaaagcaatgaaatgtgaaccgacctcaatagcaatagagttcactagagagaaaaggaaatcaaaattaacaaatacacgatacaagaaaatatcagagacctacgagaaaatcactgatgaattaataagcgaatacgaacttggaaaattgcaatcagaactagactctaaagttaataatatgagagatagatattatctatacttcatgcaattaggacgagatatgtatacaggggagaaaatgaatatagacgaattacaccaaaaatatgatattgaccacatattaccacaatcattcataaaagacgacagcctaaacaacagggtactaacttcaaaatcagtaaacatcaaagaaaaatccgataaaacagcggctgacctatacgccgcaaaaatgggagacttttggcggaaactacggaaacaaggcctaatgactgaacaaaaatacaaaaacctcctaacgagaactgattcaataaataaatatactaaacaatcatttattaaaagacaacttgtagaaacaagtcaagtagtgaaactagcagcaaatatactccaagacaaatacagaaatacaaaaatcatagaaatacgagccagactcaatagcgatcttaggaagaaatacgaacttatcaaaaacagagaagtgaacgactatcatcacgcaatagacggttacttaaccacctttgtaggacaatatctatacaaagtataccccaaattacgatcatatttcgtctatgatgactttaagaaattagattcaaactatctcaaacacatggacaaattcaatttcatctggaaactcgaagataagaaagcagaagacgtatacgacaaagtcaacgacgagttcgtcctcaatgtaccagaaatgaaagagtacatccgaaagatatataattataaatacatgttagtatcaaaagaagttacaaccaaaaatggagcattctatgaccaaaccaaatataacgctaaaacaataaatttaatcccaatcaagaaagacaaacctacaaacatctacggaggatacaaaggtaaagttagctcgtacatgatgttagttaagatccagaagaagaaagaagtaatatataaattcgtaggcgtacctcgcctatggactgatgaattagacaggctaattgacaccgacgaaaagaaagcacttttaaagaaatga

SEQ ID NO: 5178 - RNA, 3459 nt, synthetic construct
  misc_feature 1..3459: note = Cas9 variant
  source 1..3459: mol_type = other RNA
atgaacgctgaacatggaaaagaaggactacttatcatggaagaaaactttcaatatcggatcggattagatataggaatcacaagcgtaggatgggcagtactacaaaataacagccaagatgaaccagtacgaataacagacctaggcgttagaatattcgatgtagcagaaaatcctaaaaatggagatgccttagcagctccaaggagagatgcaagaacaacacgaaggagactaagaagaagaagacatagactagaaaggattaaattcttattacaggagaatggcttgattgaaatggactcattcatggagagatattataaagggaacctaccagacgtctatcaactaaggtacgaaggactcgatagaaaacttaaagatgaagagttagcacaagttttgatacatatagcgaaacatagaggatttaggtcgacaagaaaagcagagaccaaagagaaagaaggcggggccgtgttaaaagcaacaacagaaaatcaaaagataatgcaagaaaaaggataccgaacagtaggtgaaatgctatatttagacgaagcatttcatacagaatgcctgtggaacgaaaaaggatacgtactcacaccaagaaatcggccagatgattataaacatacaatactacgcagtatgttagtggaagaagtgcacgcgattttcgcagctcaaagagcacacggaaatcaaaaagcaacagaaggacttgaagaggcttatgtagaaattatgaccagccagagatctttcgacatggggccaggactacagccagatggaaaacctagtccatatgctatggaaggatttggagacagggttggaaaatgcacattcgaaaaagacgaatatagagcaccgaaagctacctacacagcagaattatttgtagcgctacagaaaatcaaccacacaaagctaatagacgagttcggaacaggaagattcttctcagaagaagaaagaaaaacaatcataggattattattgagctctaaagagttaaaatatgggacaataagaaagaaattaaacattgacccgagcttaaaattcaattcattaaactatagcgcaaagaaagagggtgaaacagaagaagaacgggtactagacacagaaaaagctaaatttgcatcaatgttttggacatacgaatactctaaatgtctaaaagacagaacagaagaaatgcctgtaggtgaaaaagctgatctattcgacagaataggcgaaatattaacagcatacaaaaatgatgattctagatcaagtagactaaaagaattgggactatcaggtgaagaaatagacggtttattagatttgagtccagcaaaatatcaaagagtctcacttaaagccatgaggaaaatgcaaccttatctagaagatggactcatttatgataaagcatgtgaagcagcaggatatgattttagggctctaaatgatggaaacaagaaacatctattaaaaggagaagaaataaatgcaatagtaaacgacataacaaacccagtcgtaaaaagatcagtatcacaaacaattaaagttataaacgcaattatacaaaaatatggcagcccacaagcagtaaacatagagctggctcgagaaatgtctaaaaattttcaagatagaacaaacttggaaaaagaaatgaagaaaagacaacaagaaaatgagagagcaaaacaacaaatcattgaacttggaaaacaaaacccaacaggacaagatatcctaaagtatagactatggaacgatcaaggaggctactgcctttacagtggaaagaagattccactagaagagttatttgacgggggatatgacattgaccatatcttgccgtacagtatcacatttgacgacagttatagaaataaagtattagtaacagcacaagagaatcgacaaaaggggaatcggaccccgtacgaatatttcggcgcagacgagaaaagatgggaagattacgaagcgagtgtgaggctattagtacgggactacaagaaacaacagaaattactaaagaaaaactttacagaagaagaaaggaaagaatttaaagaaagaaacctaaatgacacaaaatatataactagagttgtatacaatatgatcagacaaaatctagaactagaaccattcaaccatcctgaaaagaagaaacaagtatgggcagtcaatggagcagtaacaagctatctaagaaaaagatggggattaatgcaaaaagatcgctcaactgacagacaccatgcaatggatgcagtagttatagcatgctgtacagacggaatgattcataaaatatcaagatatatgcaaggaagagaattagcatacagtcgcaatttcaaatttccagatgaagaaacgggtgaaatactaaacagagataattttactagagaacaatgggacgagaaatttggagtaaaagtacctcttccatggaacagctttagagatgaattggacataagactgttaaatgaagaccccaaaaatttcctgctcacacatgctgacgtgcaaagagaattagactatccagggtggatgtatggagaagaagaatcgcctatagaagaaggaaggtatatcaattatattagaccattatttgtcagcaggatgcctaatcataaagtaactggatcagcacatgacgcaacaatacggtcagcaagagattacgaaacccgaggagtagtgataacaaaagttccactaacagatctaaaactcaataaggataacgagatcgaaggctactacgacaaagacagcgataggctactttatcaagcgctagtcagacagctgctactacatggtaacgatggaaagaaagcattcgcagaagattttcacaaaccgaaagcagacgggaccgaaggtccagtggtaagaaaagtaaaaatagaaaagaaacaaacaagcggcgtgatggttagaggaggcactggcatagcagcaaatggcgaaatggtaagaatagatgtattcagagaaaacggaaaatattattttgtccctgtatacacagcagatgtcgttagaaaagtattaccaaatcgagcagcaacacatactaaaccatactcagaatggagagtgatggatgacgccaacttcgtcttttcactatattctagagatctaatacacgtaaaaagcaaaaaggacattaaaacgaacttagtaaatggaggtctactattgcaaaaagaaatattcgcatactacacaggagctgacatagcaacagcttctatagcagggtttgcaaacgatagtaattttaaattcagaggtttggggatacaaagtctagaaatattcgaaaagtgtcaagttgacatactcggcaacatcagcgtagtcagacatgaaaataggcaggaatttcattga

SEQ ID NO: 5179 - RNA, 3462 nt, synthetic construct
  misc_feature 1..3462: note = Cas9 variant
  source 1..3462: mol_type = other RNA
atgaaaaacatactaggactagatcttggattatcatcgataggctggtcggtaatcagagaaaacagcgaagaacaagaattagtagcgatgggcagccgcgtcgtatcattaacagcggcagaactaagctcttttacccaaggaaacggagtatcgataaatagtcaaagaacacaaaaacgaacacaaaggaaaggatacgatagatatcaactaagaagaacattacttcgaaataaattagacactctaggtatgctgcctgatgattcattatcatacttaccaaaactacaactatggggacttagagccaaagcagttactcagagaattgagttaaatgaattaggcagagtgctccttcatctgaaccaaaaacgaggatataaaagcatcaaaagcgatttctcaggcgacaaaaagattacagactacgtaaaaacagtaaaaacaagatacgatgaattgaaagaaatgagattaacaattggcgaactgttctttcgaaggctaacagaaaacgcattctttagatgtaaagaacaagtatacccacgacaagcatacgtagaagagtttgattgtataatgaactgtcaaagaaaattctacccagatatactaaccgacgaaacaataaggtgcataagagacgaaattatatactatcaaagacccctcaaaagttgtaaatatctagtaagtcgatgcgagttcgaaaagaggttttatttaaatgcagcgggaaagaaaactgaagctggcccaaaagtctcacccagaacaagccccctattccaggtctgcagattgtgggaatccataaacaatatagtagtaaaagacagacgaaacgaaatagtgtttatatccgcagaacagagagctgcactctttgatttcctaaacacccatgaaaaactcaaaggatcagatttattaaaattactgggattaagcaaaacctacggatatagattaggcgaacaatttaaaaccgggatccaaggaaataaaacccgagtagaaatagaaagagctctaggcaattatcctgacaagaaaagattactacaattcaatcttcaagaagaaagctccagcatggtcaacacagaaaccggcgagataataccaatgatatctttatcattcgaacaggaaccactttataggttgtggcacgttttgtatagtatcgatgatagagaacaattacaatcggtattaagacagaaattcggaattgacgatgacgaagtattagaaagattaagtgcgattgacctggtaaaagccggattcggaaacaaaagttcaaaagctatccgacgaatactaccatttctccaattgggtatgaattacgctgaggcatgtgaagcagcaggttataatcattcaaataactacaccaaagcagagaacgaagcaagagctctgctcgatcgactgccagctataaagaaaaacgaattaagacaacccgtcgtagagaaaatactaaatcaaatggtaaatgtcgtaaatgccctcatggaaaaatacggacgctttgatgaaataagggtagaattagcaagggagttaaaacaatcaaaagaagaaagatcaaatacatataaatcaattaacaaaaaccagagagaaaatgaacagatcgcaaaaaggatagtagaatacggagtaccaacaagatcaagaatccaaaaatataaaatgtgggaagaatcaaaacattgttgtatatactgtggacagccagtcgacgtaggagactttttacgaggttttgatgtagaagttgaacacatcatacccaaatcattatacttcgacgactcatttgcgaataaagtctgctcgtgtagatcatgcaataaagaaaagaataatagaacagcatatgattatatgaaatccaaaggagaaaaagcactaagcgattacgtagaacgagtaaacacgatgtacacaaacaatcaaataagtaaaacaaagtggcaaaatttactaaccccagtagacaaaattagtatcgactttatcgacagacaattaagagaatcacaatacatagcaagaaaagctaaagaaatactaacaagtatatgctataatgtaaccgctacaagtggatcagtgactagctttttacgacatgtatggggatgggacacagtattacatgatctaaatttcgatcgctataagaaagtgggacttacagaagttatagaagtgaatcaccgaggaagcgtaatacgcagagaacaaataaaagactggtctaagagatttgaccaccgacaccatgccatagatgccctaacaatcgcatgtacaaaacaagcctatatacaacgactcaataatcttagagcagaagaaggtcctgacttcaacaaaatgtccctcgaaagatatatacaaagtcaaccacactttagtgtcgcacaagtgagagaagcggtagatcgcatcctagtgagcttccgagcaggtaaaagggcagtaacaccaggaaaaagatacataagaaagaatagaaaacgaatttcagtacaatcggtattaatacctagaggtgcactatctgaagaatcagtttatggcgtgatacacgtctgggaaaaagatgaacaaggacatgtaatacaaaaacaacgcgcagtaatgaaataccccataacatctataaatcgagaaatgttagataaagaaaaagttgtggataaaagaatacaccgaatattatccgggcgattagcacaatacaacgataacccaaaagaagcgtttgcaaagccagtatatattgataaagaatgtcggatacctattagaactgtacgttgcttcgcaaaacctgccataaacactctagtgccgctaaagaaagatgataaaggtaacccggtagcatgggtaaacccaggaaataaccatcacgtagctatatatcgcgacgaagacggaaaatataaggaaagaactgtaactttctgggaagctgtcgatcggtgccgggttggaataccagccatagttacacaacctgatactatttgggataatatactacaacggaatgacatatcagagaatgtactggaatcattacccgacgtaaaatggcaatttgtattaagtttacaacaaaatgagatgttcatattaggaatgaatgaagaagattatagatatgcgatggatcaacaagattatgcactactaaacaaatatctatatagagtacaaaaattatcaaaatcagactacagttttcgctatcataccgaaacaagtgtcgaagacaaatacgacggcaaacctaatttaaaactcagcatgcaaatgggaaaactaaaaagagtctcaataaagagcttactaggtctaaacccacacaaagtgcacattagtgtactaggggaaataaaagagatatcttga

SEQ ID NO: 5180 - RNA, 3474 nt, synthetic construct
  misc_feature 1..3474: note = Cas9 variant
  source 1..3474: mol_type = other RNA
atgaattactataacggtttcataataacagaaaacgctatgacatccaaacaagaaaaacacggagcactaacattcgggcttgacatagggattgccagcgtcggatgggcagtattaggagaatctcgaattgtagatttaggagttcgatgttttgataaagctgaaacagcaaaagaaggcgaatcactgaatctgacaaggcgcatggccagacttctaagaaggagattgaggcgcagggcatggagacttactaaattagctagactgcttaaacgagaagggttaatagcagacgcaaatctctttaaacacaaaatagagaaaaatacccctgtaccaaaaagttcatggcaactcagagttgacggcttagacagacaattgaatgctgaagaatgggctagagtaatataccatctgtgtaaacatagaggatttcattggatatccagagcagaagaaaaagcggccgaaggcgatagtaaaggtgaaggaggaaaagtaaaacaaggattagcgggaacaaagaaactaatgcaagaaaaatcatatcgcacagccgcagaaatggtgcttgctgaatttccagacgcacaaagaaacaaacaaggcgattattcaaaagctctgagcagaatattgctaggggatgaactaaaagccctatttgaacaccaaagaaaactagggaatccagtggccaccgaaaaattagaagcagcaattttaggtaacggtgataagaaatgtggcctattttgggcacaaaatccagccctggccggaaataaattattagaaatgttaggaagatgtacgttcgagaaaacaggaggagacgatggcaaaggagaatatagagcaccaaaggcttctttcagtgcggaaagacacgtatggcttacacatcttaataatctacgaatagtagtcgatggcacaacccgaccattgaacgaagccgaaagacgggtcgcactacctatgccataccaacaagcaggcgatttatcatataaacagctaggaggagcattaattaaagaaggttttctccaaaaagatggattcaaattcgcaggattaccatatcctacaaaacaagcatcagaagaaaaagcaaaagatccagaaacaagtgtcttgtgtaaattaccagcgtggcatactttaagaaaaacattagaaaaacacggtttagaaagcgagtggcaaaaactatctacagatgcattagacggaaagccacaactactagacaacattgcgtgggttttatctgtatataaagatgatgatgaagtaaaaacagaactgggaaagttaaatcttccaaacacagagaaaatgatagacgcattattagacataagatttgataaattttcaaatctaagtctaaaagcattatctaaaatcgtaccatttatggaacaaggacaacgatatgatgaagcagtcgcaaatataccagaatacggacaccatagtcaactacacaaagtaggagcgggagaacataaatatctcccaccgttttacaaggaaagagataagacaggaagaatggtgtttaatgacgatatggatatcccgagaaacccagttgtcttaagggcattaaaccaagcaaggaaagtagtaaacgctcttattaaagaatatggtagtccgcatgaagtacatatagaaatggccagagatttaagtagaccattagatgaacgtcgagatatagagaaattacaaaaagaatttggggaaagaaataagaaagacaaagaactttttgcacaggattttaacatagtaggaacagttaaaggaaaacaatttgaaaagtaccaactctaccgagaacaacaaggcaaatgcatatatcctagtatggacgaaaaacaggggatctgctgttattcgctaaaaccactagacttacatagagtcttatacgaagaaggttacgctgaaattgatcatgcattgccgtactcccgttcttttgatgattctaaaaacaacagggtattagtcctagcaaaagaaaacagagataaaggcaatagaaccccctttgaatacctaggagataaagataattcagaaccatggcgtcaatttgtagccttcgttgagggaaataaagcataccgtttagcaaaacgaagtcggttattaaggaaagacttcggagacaaggaagccaaagaatttagagaacgaaaccttaatgatactcgttatatatgcaaattctttaagaattatgtagaacaatatttacaactgcacgaagactcggaagctaaacgatgcgtcgtactaagtggccaaatgacatcttttctaagagcaagatggggactggtaaaagtaagaggcgactcagatagacaccatgctctagatgctgcagtagttgcagcatgtagtcacggcatggtcaaacgactatcagactacagcagaagaaaagaattggagcaagttcgagaaggatttgtcgacgtagatacaggagaaatagttaaccccgccatgtttcaacaagttcaagaacactttcctaacccgtggccacactttagagatgaggttaaattgagattaagcatagatgatccaactctcttgagaagtgaaatggaaaaatttggaacatacacaccagaatcactagaagcattacgtcctttatttgtaagtagggcacctcaaaggagaaatagcggagcagctcacaaagatactatatatgcgcaacccaaaagactcgtcgcacagggcggtgttacacaaaaagttgccctgagctcattaactttaaaagacctcgataaattaatagatcctcaccgaaatgaaagattatacgccgctatcagagctagactagagcaacacggcggcaagggagacaaagcatttccagcaagtaatcccttaaggaaacctgatagtgaaggaaatccaacgggccccatcgtgcgaggggtaacaatggtaattgacaagctatcgggtatacctattaggggaggaatagctaaaaatgactcaatggtacgcgtagacgtttttactaaagcaaataaatttcatctagtacccgtatatgttcatcactccgtgttaggactaccaaatcaagcaatagtcggtggtaaagaagaatcagaatggactcaaatagacgatagtttcgattggcatttctcaatttatccaaatgacttaattagagttactttaaaacaagaaggtagattcggatattatgcaggctgtgaccgaagcacggcagctatacacctttgggcacatgatagaaatcaacaagtaggcaaagacgggttaattagatcaataggagtgaaaacagcactatctatagaaaaatttaacgtagacgtacttggaaatcgatacccagcacctccagaaaagagaagagacttagcctga

SEQ ID NO: 5181 - RNA, 3486 nt, synthetic construct
  misc_feature 1..3486: note = Cas9 variant
  source 1..3486: mol_type = other RNA
atgaagaaaatattgggactggacttaggaagtgcgtcaatagggtgggcattagtagaagaaacagaacaaatgcaatataatatagtctcacttggaagtaggataataccatacaacggaacagaaggacaggaatttgaaaaaggaaccggagaatcaagaaatagtttaagaacgaaagcaagaacagccagaaaaggatacgatagataccaactgagaaggaaaaacttggagaaaatattacttcaaaatggcatgtacccaaatgaacaagtaagagcactacaaaaacttgaactgtggaaactaagagccgacgcaccgaacgtacaaatatccttaccggaactaggaagattacttttctggttgaatcagaaaagaggatacaaaagctccagatcggacgcaaatttagacaagaaagatacagaatatgtcgccacagtaaaatctagacaccagaaaataaaagatgctggacaaactgtcggtcaatatttctacgggcaaatattggaaaacgaataccacagaattaaagagcaagtatttcctagagaggcatatatagaagagttcgacgcaatagtggcgaggcaaaaagaatattaccccaccattcttaaacaagaactaatagataaaataagaaacgaagtaatctacttccaaagaggacttaaaagtcaaaaaggactcgtttcagtctgcgaatttgaaggaagagagttcaatggacacttcggcggcccgaaagtagcgccaaaatcgagtccaatattccaactaggaaagatatgggaaaacattaacaacataaaaatagctgacatcgaactaacagctgaacaaaaattagtattctttaattatcttaactgccatgaaagaataacagaagcaaaaataagagaattactaaaactaagcaaagactcaaggttgaacggacaattgaaaaacggtttaacaggtaataaaacgtactctcaaatagcaagttgttttggaaacaagatcggagagtacgaaagactatttaaatttgaattagaagtaattgagagcgagaaacttgaatacacataccatcccaaatctcacatacccgtgggagagaaaagaagaaagtacatatctgaaaatgttgaaaaagaaccttactatcggttatggcatactatctattcaataaaagacaaagacgaatgcagagcagcattaatcaaaaattttggcatagaagaagaaatagcggaaaaactagcaagtttggatttcagtgcgggagggtttggaaacaaatgcgccaaggttataaggaaaatactaccgtacctaatggaaggggataaatataatgttgcaatggactatgctggttacaatcactcatttagtcaaactaaagatgaaaacctccaacgcgtactattggatagcataaatcacctacccaaaaactcattaagacaaccaattgtagagaaaatactaaatcaaatgataaacctggtaaacgaagtaataaaacaatggggtagaccagacgagattcgcgtagaactcgcaagaaaattaaaacaatcgaaaacagaacgaaatgatgatgacaatttcatgagaaagagagaaagagaaaacgagataatcaaggcagacctagcaaaatacggattaaaagcgacaagaaataacgtaataaagtggagactatatcatgaaatcgatgacaaagataagaaacttaatgcaaggtgcatatattgcggacaacccataagccttacagaagccattttaggaaacaacgtggatgtagaacacataatacctaaagacaaattatttgacgacagccaaagtaacaaaacgcttgcgcaccgatcatgtaactcgggcaaaggaaacaaaacagcctacgactttatgaaagacaaaccacaatttgaggaatacgttgctagagtagaagaattatacaagaaacatttaatttcacttacaaagaaacgcaaatttctgatgagcgaagataaaatcccatctgattttattgatagacaactgagggaatcacaatatatcgcaagaaaatcaagagaaatactacaaacagtttgcagaaacgtatggtctactgatggaggagtaactgcacacctcagaaaattatggggatgggacgatgtaactatgaatctacaaatgccgaaatacaaaggaatagggatgacagaaatagtggaatgggaatcaaaccatgggaaaaatcaacatacacaggaagtaataaaagactggtcaaaaagagacgaccacagacatcatgctatagatgcgcttgtagtagcttgcacgagacaaggatacatccaaaggattaataccctaaactccagtgaaactaaagatgaaatgcaccgtaaagtagcggggtccttagtcgagttcaatcaaaaacatacattattaaataaataccttataacagaaaaaccatttaccacatcagaagtcgaagacgtagtaagcaaaatattagtaagtttcaaagcaggaaagaaagctgcaacacccggcaaaagaaaagtgggaaaacgaggaaataaacaagtagtacaagacggcatcataataccacgtggagctttgcatgccgattccgtatctggaagtattaaacaatatgaccctacaggcaactttgaaaaccataacgtaataaaatataaagtaggagttggaaaaggttatttatttgacggaaaagatgacaaaaagaaaattgataaaactatagactgcatcgtagacaagaaaattagagacttaataaaacaaagagcggaagaaagcaattacagcctgaagaaaatgttcgaaactccgatattatttaatcaaagagcagtattctccgtgagatgtaaaaccggaaacaaagcagtggttccaatcagaaacggatacgtagtacctgacaataatcaccacacggccatatacaaatatgacggcggcttaaaagaacaatgcgtttcgttaatgcaagcgatagaaagaaaaagatacaaccttcctataataatcaaaaatccaaaagaaatatacgacaaaataaccgaaatagctaacatcaatcaactgctattcgacagtctaccgaaactagactgggaatttgtaacgacactccagaaaaacgatatgtttatcctcgggatggactacagcgccacagaagaagcattggctgacggcaattacagacttctaagcgaatacttgtataaagtacaaaacataagtgatggtatatatagactatgtcaccatacaataaccaaattcgatttaagcaaagcaaacaaaccagacaaaagattctacaacatacaatcattaaaagcatggaatacactcaacccacaaaaagtaaaaataaacatattagggcaaatagaacgacaatga

SEQ ID NO: 5182 - RNA, 3501 nt, synthetic construct
  misc_feature 1..3501: note = Cas9 variant
  source 1..3501: mol_type = other RNA
atgcatgttgaaatagacttcccccacttctcgcggggtgattcacacctcgcaatgaataaaaatgagatattacgaggctcatccgtactctacaggctaggactagacctaggatcgaatagtttaggatggtttgtaacacatttggagaaaagaggtgacaggcacgaaccagttgcattaggaccaggcggtgtaagaatattccctgatggacgagatccacaaagcggaacctctaacgcggtggatagaagaatggcccgtggagctagaaaaagaagggatcgatttgttgaacgacgtaaagaattaatagcagccttaataaaatacaatctactaccggatgacgcaagagaacgtagagcattggaagtattagacccatacgccttaagaaagacagcattaacagacacactcccagcacatcacgtaggcagggctctttttcacttaaatcaaaggagaggatttcaatcaaatagaaagacagactcaaaacaaagcgaagatggcgcaataaaacaagcagcatcaaggctcgcaacggacaaaggtaacgaaactttaggagttttctttgcagatatgcatttacgcaaaagttatgaagatagacaaacagctatacgtgcagagctagttagattgggtaaagatcatttaacaggaaacgcaagaaagaaaatatgggcaaaggtgcgaaaaagattatttggagatgaagtactcccgagagcagatgcaccacatggtgttagagctagagcaacaattaccggcacaaaagcgtcctacgattactatccaacaagagatatgctcagggatgaatttaatgcaatatgggccggacaatctgcacaccacgctactataactgatgaagcaagaacagaaatagaacacataatattttatcaaagaccgctgaaaccggctatagtaggaaaatgtactttagatcctgcaacacggccattcaaagaagaccccgagggatacagggcaccatggagtcatcccttggcacaacgatttcgcatactcagcgaagctagaaacctagaaatacgagataccggtaagggatctagaagattaactaaagaacaatctgacttagtagttgccgcactattagcaaatagagaagttaaatttgataaattaagaacactgctaaagttaccagcagaggcaagattcaatctcgaatctgaccgtcgagccgcattagacggagatcagactgcagcaagactaagtgataagaaaggttttaacaaagcatggagaggctttcccccagagagacaaatagcaattgtagcaagattagaagagacagaagacgaaaatgaacttatcgcatggttagaaaaagagtgtgcattggacggagcagctgccgcaagagttgcaaacacaaccttaccagacggtcattgtcggttaggactacgggctataaagaaaattgttcctataatgcaagacgggttagatgaagatggagttgctggagcaggttatcatatagcagcaaaaagagcgggatatgatcatgcaaaattaccaacaggagaacaattaggaagattaccatactacggacaatggcttcaagatgcagtagtaggtagtggagacgctagagatcaaaaagaaaaacaatacggacaattcccaaatccaactgtacacataggactaggccagcttaggagggtagtaaacgacctcattgataaatacgggcctccaacagaaatatctatcgaatttacaagagccctaaaattatcggaacaacagaaagcagaaagacaaagagaacaaagaagaaatcaagacaaaaataaagcccgcgcagaggaactcgccaaatttggcaggccagcaaatccaagaaatctcttaaaaatgagattatgggaagaactggcccacgacccactagatagaaaatgtgtctatactggcgaacaaatttctatagagcgactattgtcagacgaagtggatatcgatcacatattaccagttgcaatgacactcgacgattcgccagcaaacaaaatcatatgcatgagatacgcaaaccgacacaaaaggaaacagacgccatctgaggcttttggcagttcgccaaccctacaaggtcacaggtataattgggacgacatagcagccagagcaacaggcttacctagaaataaaaggtggagattcgatgcaaatgcaagagaagaatttgataaaagaggaggattcttagctcgacaattaaatgaaacgggatggttagcaagactggcgaaacaatacttaggagcagtaacggatcctaaccagatttgggttgtacccggaagactcacatcaatgctacgcggtaaatggggcttaaatggattactccctagcgacaattatgcaggagtacaagataaagcagaagaatttctagcaagtacggatgatatggaatttagcggggtcaaaaatagagcagatcatagacatcacgccatagatggacttgtaactgcactaacagacagaagtttgctgtggaaaatggcaaatgcgtatgatgaagaacatgagaaatttgtgatagaaccaccatggcctactatgcgagatgacttaaaagctgcattagagaaaatggtagtcagccacaaacctgatcatggaatcgaaggcaaactacacgaagactctgcatacggatttgttaaaccattagatgcaaccggattaaaagaagaagaagcaggtaatctggtgtatagaaaagcaatagagagtctcaacgaaaatgaagtagatagaatccgcgacattcaattgaggactattgtcagagatcacgtaaacgtagagaaaactaagggagtggcactcgccgacgcattaagacaactgcaagctcctagtgacgattacccccaatttaaacatggtttaagacatgtaagaatcctcaagaaagaaaaaggtgattacttggttccaatcgctaatagggcctcaggagtcgcatataaagcatacagtgcgggagaaaatttctgtgtagaagtatttgaaaccgccggtggtaaatgggatggagaagcagtaagacgttttgatgcaaacaagaaaaatgcgggaccaaaaattgcgcatgcccctcaatggagggacgcgaacgaaggtgcaaaattagtaatgaggatacataagggggacttaatcagattggatcatgaaggaagggcaagaataatggttgtacatcgtttagacgctgcggcaggcagatttaaactagcagatcacaatgaaacaggaaatttagataaaagacatgcgaccaataatgatattgatccatttagatggttaatggcaagttataacactttaaagaaactggcggcggtcccagtacgtgtagatgaactaggtagagtatggcgagtaatgccaaattga

SEQ ID NO: 5183 - RNA, 3507 nt, synthetic construct
  misc_feature 1..3507: note = Cas9 variant
  source 1..3507: mol_type = other RNA
atggcaagaccagcattcagagcaccaagaagagagcatgttaatggatggacacccgatccacaccgtataagtaaacccttctttattttggtatcctggcaccttttatccagagtagtaatagattcatccagtgggtgctttccgggaacaagtagggatcatactgacaaatttgccgagtgggaatgtgcggtgcaaccttatcgattaagttttgacttaggcacaaattcaataggctggggattacttaatttagacagacaaggcaaaccgagagaaataagagcactaggttctagaatatttagtgatggtagggacccccaagataaagcaagtttggctgtggcacgtcgactagcacgacaaatgagaagaagaagagacagatatttaacgcgaagaacgcgattaatgggagcattagtgagattcggattgatgcccgctgatccagcagcaagaaaaaggctagaagtagcagtagatccgtatttagcgagagagagagcaaccagggaaaggttagaaccctttgaaataggcagagcactttttcatctaaatcaaagacgaggatacaagccagtgcgaacagcaacaaagccagatgaagaagcaggcaaagttaaagaagccgtggagcgattggaagcagcaatagcagcggcaggagcgccaacactaggagcgtggttcgcgtggcgtaaaactagaggcgaaaccttaagggcgcgacttgcaggaaaaggaaaagaggcagcttacccattttatcctgctcgtcgtatgctggaagccgagtttgatacactatgggctgaacaagctagacatcatccggatctactaacagcagaagccagagagatcctaagacatagaatcttccaccaacgcccacttaaacccccacctgtgggtagatgtactttatacccagatgatggcagagcaccaagggcacttcctagcgcacaaagattaaggcttttccaggaactagccagtctcagagtcattcatttagatctttctgagagaccactgacaccagcggagagagacaggattgtagcatttgtacaaggacggcctcctaaagcaggaagaaaaccaggaaaggtacaaaaatccgtgccatttgaaaaactaagaggactcttagaactccctccaggcacaggatttagtttggaatcagataaaagacctgagttactgggagacgaaacgggtgctagaatagcgccagcatttggtcctggctggactgcgctgccactggaggaacaagatgccttagtagaattattattaacagaagctgaaccagaaagagcgattgctgctctgacggcaaggtgggctttagacgaggctacagcggcaaaattagcgggtgcaacgttgccggatttccatggtagatacggaagaagggccgtagccgaattattaccagtattagaacgcgaaacgagaggagatccagatggacgagttagacctataagattggatgaagcagtaaaattgctcagaggtggaaaagaccattcagatttcagcagagagggagcattattggatgctttaccttattatggagccgttttagaaagacatgtagcatttgggacagggaatcctgcagatccagaagagaaacgagtaggtagagtcgcgaatccaacagttcatatagcattaaaccaattgcgtcatttggtgaacgcaatattagctcgccacggacgaccagaagaaatagtaatagaactagcccgagatttgaaaagaagtgctgaagataggcgtagagaagacaaacgacaagcagataaccagaaaagaaatgaagaaagaaaacgacttattttaagtttaggagagagaccaacaccccgcaatttactgaaattaagattatgggaagaacaagggccagtagaaaatcgcagatgtccgtattcaggcgaaacaatctcgatgagaatgcttctgagtgaacaagtcgatattgatcatattttaccatttagtgtatcacttgacgattcagctgcaaataaagtagtatgcttaagagaagctaatagaataaagagaaatagaagtccatgggaagcattcgggcatgacagtgaacgctgggcaggaatactggcgagagcagaagcattaccaaagaataagagatggcgatttgccccggatgcactagaaaaattggaaggggagggcggcctcagagcaagacatctcaatgacaccagacatttgtcaagattagccgttgaatatttacgatgtgtttgtcccaaagtaagagttagtcccggaagattaacagctctcttgagaagacgatggggaatagatgcaatattagcagaagctgacgggccccctcctgaagttccggcagaaacactagacccgagccctgcagaaaagaatagagcagatcaccgacaccatgcactagatgcagtcgtcattggatgtatagatagatcaatggttcaaagagtacaattagcagcagcgagtgcggaaagggaagctgctgcacgtgaagataatattcgacgtgtgctggaaggctttaaagaagaaccttgggacggatttagagctgaactagaaagacgcgcaagaacaatagtcgtaagtcatcgacctgaacacgggataggtggcgcattacataaggagacagcatatgggccagtagatcctccagaagagggatttaatttagtggtaaggaaacctattgatggactgagtaaagatgaaattaacagcgtcagggaccctaggttaagaagggcactaatagatcgattagccataagacgacgggacgcgaatgatccagctacagcattagcaaaagcagcagaagatctcgcagcacaacccgcatcgagaggaataagaagagtcagagtcctaaagaaagaatctaacccaattagagtagaacatggaggtaacccatcaggtccaaggtcaggcgggccgtttcataaattactcctggccggtgaagtacatcacgtagatgtagcattaagagctgacggtagaagatgggttgggcattgggttacactatttgaagctcatgggggtagaggagcagatggtgctgcagcaccaccaagattaggggatggagaaagatttttaatgagactccacaaaggagattgcctaaaacttgagcataaaggaagagtgagggtaatgcaagtggtgaaactagaaccaagttcaaattctgtagtagtggtcgaacctcaccaggtcaaaactgataggtctaaacatgtaaaaataagttgcgaccaacttagggcaagaggcgcaagaagagtgacggtagacccactaggccgagtaagagttcatgcaccaggcgctagagtaggcataggtggagatgcaggaagaacggcaatggaaccagctgaggatataagttga

SEQ ID NO: 5184 - RNA, 3513 nt, synthetic construct
  misc_feature 1..3513: note = Cas9 variant
  source 1..3513: mol_type = other RNA
atgtccaaatacaacgtaggcctagatataggaatagcatcagtaggatggtctatagtggacgcagataaaaagaaaataatagatctaggaagccgaatcttttcaagcggaaacgcagccgctaatcaagaaagaaggggattccgaggaacaagacggctaataagacgcaggaaaaacagattaactgatgtaataaacttcttcggcgaaaagaaattcatcgacactaaagtagtggataaaaacggccatgtacattataaattctccgtaaataatacagaatctccttacgaacttagagtaaaaggactgtctgaaatactaacaaaacaagaattagttatagcattataccatatagttaaacatagaggcattagttacgatcttggtgacttagaagacgacggaacatcaggagtaacagactataaaacgagcataaatattaatagacaattattaaatgaaaagacagtaggtcaaatacaactagaaagactaaatgaatttggaaaagtacgtggtcaagtagaagaaaacgaaaacgtaacactacttaatgtctttccatcagccgcatacgtcaaagaagcaacacaaatattaacaaaacaacgtgaattttaccccgaaataacagacgacttcatcgctaaattcatgcttttcatcactcgaaaaagagattactttgtaggaccaggaaacgagaaaagccgcaccgactatggaatatataagaaagatggaagaacattagataatctttttgatgaactaattggtatagacaaaataaatggagagaaaagagcctcagcttcgtctttaacagcgcaaatttacaatatgctgaacgacttaaataacctaactgtcccaaatacagaagacggcagattaacaatccaaaccaagaaagaaatcctagaagcagcaaaaacgactaatggactctttggaatagcgcaaatatgtaaaattatcggatgtaagaaagatgatataaaaggttttaggatagacaaaagtgaaaagaaaatcatgcacactctatcgggctatagaaaatttcgaaaagaacttgcagacgttaacatcgaagcgaatgacctgaacattaacttggtcaacaaaatagccgatatactaaccctcaacaccgaaaaagcggaaatacgtaaacaattagacaaaagtaacatggatatttcaaatgaaatgaaagaaatagtaataaataaaaacaaagagttcctggtagacgggcgagccacgtggcactcattcagctataaaaccctaaatttactaataccggaactattaaatacaccagaagaacagatgacgatcctaactagactagggttagtaaaacccaacaataagaaatacgaaggattgaaaaatatacccgcgagaagaattacggaagaaatatacaacccagtcgtcgctagagcaacccgagaagcagtaaacgtatttaacgctataacaaagaaagtagggagagataatatcaaagacgtaataatagaactaccacgcgaagataacgaagtagacatcaaaaagggaatagttaaaagacaaaaacaaaacgaagtggaaaaagaaactgcagatgcattagtaaaacaacatatgacaatatccgattcagcactaatagcacaatatagaaaaatacgagggctatctcaaaaagtaaggtattggtaccaacaagatactatatgtccatactgcggaaagaaaatagaagcagtacagcttataaacaataacgactcgtttgaagtagaccatatagtaccaatatcggtatcattcgacgacagtcagaataacaaagtgttagtacactcacaatgcaatcaagcgaaagaaaaacaaacaccactaggatggctaaacaacggcggcggcttcggacaatcaaaagcagattatatagcgagagtcaaaagcaacaaaaattatgccaaaaacaaaatcgataatttattaaatgaaacagacctaaatgatatagcaacacaaagaggatttatacaaagaaatttaaatgacacacgatatgcatcaagaatcgtcttaaatgagttctactcattcttccgttcaaataatctaagcactaaagtaaaggtagtaagaggaaaatggacttcacaaatgcggaagaaatggaatggcgtcggtggtctgtcaaaaaccagagacacatatcaccaccatgctatagatgcttgcataatagcatgctttccattgttgaaggctttcgacaaagcaattaaattgatagacgtagatggagaaacaggagaaatcttacaagacaagaaagcaattaaactcgcacaagaagcagaaatcgtagagaaaataagcgtcatcaaaaataagaaatttgaaaatatggtaaatgaaatatacaacttcccactattcaaacaggtagaactagcaaatgatataacaaatctcgaaaacccggtaaaattcagtcaccacgtagataagaaagcaaatcgagcagttgctaaccaaacaatatacggcacacggataaaagaaaaagaagtaacaaaacgtggaaagaaagagaaaattcaagaaagatacacactcggcacaattaaaaatatatatgacatagatggcttcatgaactttaagaaactgtacgacaaaattagcaaaaatgacgatgtaaaatttctgatgcagaaaaatgaccctaaaacatgggaaaaactcatagacatattcaactcataccctgatagcgaagaagtaactcaagtcgacggaaaagtaaaacgagtagcagtaagcccattcaaactatattacagagaaaatggattcataacaaaatactcgaaacataatgatggcccaaaagtagtctcaataaaatattacgattcaaaagtaggaagccatatagacattacccccaaagatgcaagaaacaaagtaatactacaaagtttaaaaccgtggagaactgacgtatattttaacagtataacacaacaatatgaacttcttggtcttaaatatagcgacttaaaatttacgaatggagtatatggtataacacgagatgcctacgaaaaactaaaacacggagtctccgaagacggagtaactgcatggaaacctatatcgaaaaatagtgaatttagatttagtttataccgcaatgatcgagtacgagtaatagatgaaaaaggtgactcaatcgaactcttatttgcatcacgaactacatccaatgaaggatatgtcgaattaaaaccaatatacaaagcgaaatttgattcaaaagaagaagtaggattttacggattagtaagcaatggaagattaatcaagaaaatgtcgaaaggaggatacaaattatacaaagtgaatacagatatcttaggcaaaccatattacgtcacccgagaaagcgatgaaccaaaactatcactctga

SEQ ID NO: 5185 - RNA, 3516 nt, synthetic construct
  misc_feature 1..3516: note = Cas9 variant
  source 1..3516: mol_type = other RNA
atggcaaagtacagcgtcggactagatataggtatatcaagcgtaggttgggcaatcatagatatagaaacaaaacaaatagtaaaccttgggagtagaatattcccttcaggaaacgcagcaggcaaccaagaaagaagaggattccgcggaatcaggagactaatacgaaggagaaaaaatagactaacagatctaaaaaaactccttggagaaacattcttctcagacttaaaaaagatagatagcaatggttatgaatactacgacatagactttcaaataaatgcaaacccatacgaactacgcgtaaaaggaataacagaaaaattatcaaaaaaagaattagcagtcgtactgcatcacataataaaacacagaggtatatcatacgacttaggcgatctagaagatgacggtacatcaggtgtttcagactataaaaactcaattaacataaatcgccaactactacgagaaaaaaccgtaggacagatacaactagaaagattaatcgaatttaaccaggtacatggtcaagtcaaaaaagctgaggacgtgtctctattgaacgtatttccgagttcagcatatagagacgaggcaaacaaaattatgataaaacaacaagaattttattccgaaataaccaactcttttatggaacaagtggaccaactagtatcaagaaaaagagactattttataggaccaggaaacgaaaaaagcagaaccgactatggaatatacaaaagcgacggtcgaacacttgataatctctttgcagaattaataggaacagacaaaataaacggagaaaaaagagcgagcgcatctagtctaacagcccaagtatacaacttattaaacgaccttaataacctacacgtttcaaacactgaagatggcaaattaacaacaagcaccaaaaaagaaataataaaagcagcgaaaacaactgacggcgtgtttggaataagccaaatatgcaaaataataggatgcaaaaaagaagagattaccgggttcagacaagataaatcggaaaaaaaagtaatacacacactagcaggttacagaaaaataagaaaagcactagcaaccataaatatcgaagcaaatgaactgaatcccaccgtattcgaccaaattgcagacattttaaccctaaatacggagaaagccgaaattagaaaacaactagataaagtccaacttgacataacagatgagatgaaagaactagtcattgataaaaacaaagactttctcgtggatggaagagcaacatggcatagctttagctatcaaactttaaacatgctaataccagagttgctaaacacatcagaagaacaaatgaccattctgacaagaatggggctaatgaagagcgacaatgaaaaataccgtgggctaaaaaaaataccagcggaaaaaatagccagcgaaatattcaatccagtagttgcaaaatcaaccagagaagcaatcaaagtattcaatgcaataagtaaagaaataggcaaaaataacatagagcacgttgttatagaattaccgagagacgataatgaagaagatgaaaaaagaaaaattcaaaaattacaaaaagcaaatgagacagaaaaagaagccgcagacaacctcgtaaaacataagttaggaatatcagactcggctctaatagctcactatagaaaattcaaaggattatcacaaaaagtacgatattggtaccaacaagaaacatattgcccatactgcggcaaaataatagaagcaacacaactcataaacaacaatgataatttcgaagtagatcacatcataccgataagtgttagctacgacgactcgcaaaataacaaagtgctagtacatagccaatgcaaccaagccaaagaaaagcagacaccactaggctggatcaacaatggaggaggtttcggacaaagcaaaaatgaatacacaaatagagtaaaaaataataaaaaatactctaaaaacaaagttgacaatttattgaatgaaacagacttaaccgacattatcactcaacgatcattcatacaacgaaacctcaacgacacaagatatgcagccagaaccgttctagacgagttctactctttctttaagtcaaacgacttaccaactaaagtaaaagtcgtccgtggaaaatggacaagccaaatgaggagaaaatggaacaatgtaggcggtttaagaaaaacaagggatacacaccaccaccacgccatagacgcaagcataatagcatcattcccactgttaagagcatttgacagagccataaaactcatcgacgttgacaaagaaactggagaaatagtgcaatatggcaaagcaagcttaaacggagatgtcatcgaagaaaaatcagtgatccaagcaccaatcattaaaaatgaaaaatttgaaaaactggtagatgaaatctataacttcccactattcaaacaagtagaattagccaataacatagaaaacccagaaaatcccgtcaaattctcacaccatgttgataaaaaagctaaccgaacagtagcgaaccaaacaatatactccacaagaataaaaaaaacagaaaaaatagtaagaaagaaagtaacagcaaaagaagaagaatacgttatcggaacaataaaagacatttatgacgtgacaaattttgaaaaattcaaaaaactttatgatgaatcatccaaaaaagatgacataaaattcttgatgcaaaaaaacgatccgaaaacatgggaaaaattagttgaaataatgaacacttatccagattacgaagaaatttcccaactagacggtaaagtgaagagagtcaaggtaagtccttttaaactatatttccgggaaaatggtttcataacaaaatatgcaaaacataacaacgggccaaaggtggtaagtattaagtactatgactcaaagctaggcaaccacatagatataacacctgtcaatgcaaacaataaagtaatattacaatctctaaaaccatggagaactgacgtatactataacaacgaaactcaacaatacgaactcctaggactaaaatactcggacctaaaatttacaaaaggtgtttacggaattacaagagaagcatatgaaaaattaaaatacggctacacagacggcgtaccggcatggaaacctatatctaaagagtccgaatttaaattttcactatatcgaaatgatcgggtaagaataatcaatgaagccggagaaaaaatcgaccttctattcggctctagaaatgaaacgagcgaaggttacgttgagatgaaaccaatattcaaaacaaattttgacgatgctgaagaagcaagtttttacggtaaaactagtaacaaaagactaataaaaaaaatggcgaggaaaggctaccaaatctataaagtaaatacagatatattaggaaatctgtactacacagcaaaagaatcaaacgaaccaaaattagacttatga

SEQ ID NO: 5186 - RNA, 3519 nt, synthetic construct
  misc_feature 1..3519: note = Cas9 variant
  source 1..3519: mol_type = other RNA
atgagaaaaccctactcaataggcttggacattggaacaaattccgtcggatgggcagtaataacagacgactacaaagtcccctcaaagaaaatgagaatacaaggaacaacagatcgcacgagcataaagaaaaatttaataggggcattactattcgataacggggaaacagcagaagctacacgattaaaaagaacaacacgaagacgatacacaagaaggaaatatagaattaaagaattacagaaaatattttcatctgaaatgaacgaactcgatatcgcattctttcccagactatcagaatcctttttagtatccgatgacaaagagtttgaaaatcacccaatattcggaaacttaaaagatgaaatcacatatcataatgattacccaaccatataccacttacgacaaacactagcagacagcgaccaaaaagcggatctaagattaatttacctagcactagcacacataataaaattcagaggtcactttttaatcgaaggcaatcttgacagcgaaaacacagatgtacatgtactattcttaaacttagtcaacatatataacaatctatttgaagaagacatagtagaaacggcaagtatcgacgcagagaaaatattaacctcaaaaacttccaaatcaagacggctagaaaatctcatagcagaaatcccaaaccagaaaagaaacatgctgttcggaaacctcgtctcattagcattaggtttaacaccaaacttcaaaaccaactttgaactcctcgaagatgcaaaattacaaatatcaaaagacagttacgaagaagaccttgataacttactcgcgcaaataggagatcaatacgcagatctgttcattgctgccaagaaactctcggacgcaatactactttcagacattataacagtaaaaggcgcatctacaaaagcaccactaagtgcatcaatggtccaaagatacgaagaacaccaacaagacctagcattactgaaaaacttagtaaagaaacaaatacccgaaaaatacaaagaaatctttgataacaaagagaaaaatggctacgccgggtatatcgatggaaaaacatcacaagaagagttctacaaatatataaaaccaattttattgaaattagacggaacagaaaaactcatatcaaaattagaaagggaagatttcctcagaaaacaacgcaccttcgacaatggatctatcccccaccaaatacatttaaacgaactaaaagcaataataagacgtcaagaaaaattttacccatttttaaaagaaaaccaaaagaaaatcgaaaaactctttacattcaaaattccttactacgtaggaccactagcgaacggtcagagctcattcgcatggctaaaaagacaatcaaacgaaagtattacaccttggaacttcgaagaagtagtagaccaagaagcaagtgcgagggcattcattgaaagaatgactaatttcgatacatacctccctgaagaaaaagtactacctaaacatagcccactttacgaaatgttcatggtatacaacgaattaacaaaagtaaaataccaaacagaaggtatgaaaagaccggtattcctcagctctgaagataaagaagaaatagtaaatttattatttaagaaagaaagaaaagttactgtcaaacaactaaaagaagaatatttcagtaaaatgaaatgctttcacacagtaaccattttaggagtagaagacagatttaatgccagcttaggtacatatcacgatctcctcaaaatattcaaagacaaagcattcctagacgacgaggcaaaccaagacatacttgaagaaatagtgtggacacttactttatttgaagaccaagcaatgatcgaacgaagattagtaaaatatgcagatgtcttcgaaaaatcagttctaaagaaacttaagaaaagacactacacaggatggggacgactaagccaaaaactgattaacggtataaaagacaaacaaacaggaaaaacaatcctaggattcttgaaagatgatggagtagcaaataggaactttatgcagctaataaacgatagctcgttagacttcgcaaaaattatcaaaaacgaacaagagaaaacaatcaaaaatgaaagcctagaagaaaccatagcaaacctagcaggttccccagccatcaagaaaggcatactccaaagcatcaaaatcgtagacgaaatcgtaaaaatcatggggcaaaatccagataacattgtaatagaaatggcaagagaaaatcaatcaacaatgcaagggatcaaaaactctagacaaaggttaagaaaactagaagaagtacacaaaaatactggatcaaaaatattaaaagaatataacgtatcaaatacacaactacaaagcgacaggctatatctatatcttctccaagatggaaaagatatgtatacaggaaaagaacttgattatgataacctatcacaatacgatatagatcatataataccacaatcattcataaaagacaactccatcgataacacagtacttaccacccaagcgtcaaaccgaggaaaaagcgacaatgtgccaaatatagaaactgtaaacaaaatgaaatcattttggtataaacaactaaaatccggcgcaatctcacaaaggaaatttgaccatctaactaaagctgaaagaggagcactatctgatttcgataaagccggatttattaaacgacagttagtagaaactagacaaatcacaaaacacgtagcacaaatacttgacagcagatttaatagtaatttaaccgaagatagcaaatcaaacagaaacgtaaaaataataactctaaaaagcaaaatggttagcgacttcagaaaagactttggtttttataaattacgtgaagtcaacgactaccatcacgcacaagacgcatatttaaatgctgttgtcggaacggccttattaaagaaataccctaaattagaggccgagttcgtatatggagactataaacattatgatttagcaaaattaatgattcaacccgactctagcctaggcaaagccaccaccagaatgttcttttacagtaacctaatgaacttctttaagaaagaaattaaacttgcagatgatacaattttcacacgtccacaaatagaagtaaatacagaaacaggagaaatagtatgggacaaagtaaaagatatgcaaacaattcgtaaagttatgagttacccacaggtaaatatagtcatgaaaaccgaagtacaaacaggagggtttagtaaagaatcaatatggccaaaaggcgactcagataaactaatcgcaaggaaaaagagctgggacccaaagaaatatggtggtttcgatagtccaattatcgcttattccgtactggttgtagcgaaaaactgcaaaaggaaaaatagcaaaactaaaaattatcagcgaacatgtggaaacaaaaacaatggcacaagatga

SEQ ID NO: 5187 - RNA, 3522 nt, synthetic construct
  misc_feature 1..3522: note = Cas9 variant
  source 1..3522: mol_type = other RNA
atgcgaccaatagaaccatggattcttggccttgacataggtaccgactccttagggtgggcagtattctcatgcgaagaaaaagggcctcctactgcaaaagaacttttaggaggaggagtacgattgttcgatagtggaagggacgcaaaagaccacacaagccgacaagctgaaagaggggcctttcggagagctagacgtcaaacacgaacttggccttggagaagggatagactaatagctctgttccaggcagcgggcttaacaccaccagcagcagaaacaaggcagatagccttggctctaagaagagaagcagtatcgagaccattggcaccagacgctttatgggccgcgttgctacatcttgcacaccacagaggattcaggtcaaacaggattgacaaacgagaacgagcagctgctaaagcactagcaaaagcaaaaccggcaaaagccacagcgaaagcaactgcaccggcaaaagaagcagacgacgaagcaggtttttgggaaggggcggaagctgcattacgccaaagaatggcagcttcaggtgcacctacagtgggagcactattagctgatgatcttgatagagggcagccagttcgaatgcgttataatcaatccgatagagatggtgttgttgcaccgactagggctctaatcgcagaagaacttgcagaaattgtagctagacaatcaagtgcatatcctggtctcgattggcctgctgtcaccagattggtgctcgaccaaagaccattaagaagtaaaggagcagggccatgtgcatttttaccgggagaggaccgcgctcttagagccttgccgacagtacaagattttattattcgtcaaactctagcaaatttaagattacctagcaccagcgccgatgaacctagaccacttacagatgaagaacatgcgaaagctctagccttattatcgacagcccgttttgttgaatggccagccctacgcagagctttagggttaaaaagaggcgtaaaattcacagctgaaactgaaagaaacggcgccaagcaagcggctagagggaccgccggcaacctaacagaagcaatactagcaccattaattccaggatggtcaggatgggacttagacagaaaagatagagttttctctgatttatgggcagcaagacaagacagaagtgcactactagcattaattggtgatccaaggggaccaaccagagttacagaagacgaaacagcagaagcagtggcagatgcaatacagatagtcttgcctacgggtcgagcatcgctatccgcgaaagccgcgagagcaatagcacaagcaatggctccaggtataggatatgatgaagccgtaactttggccttaggactacatcactctcataggccacgacaggaacgactagcacgattgccatattacgctgcagccttaccggacgttggcttagacggagatccagttggacccccaccagctgaggacgatggagcagcggcagaagcatactatggtagaattggtaacatatcagttcatatcgctctaaacgaaactagaaaaatagtaaacgcgttactacacagacacggacctatactaagattagtaatggtagaaacaacaagagaattaaaagctggtgcggatgaaagaaaaagaatgatcgcagaacaagcggaaagagaaagagaaaacgcagaaatagatgttgaactacgtaaatcagatcgttggatggcaaatgcccgtgaaagaagacaaagggttagattagcaagaagacaaaacaatctctgtccctacacatccactccaataggacatgcggaccttcttggagacgcatatgacatagatcatgttattccgttggcaagaggaggacgagacagtctagataatatggtactatgccaatcagacgcgaacaaaactaaaggtgataaaactccatgggaggcattccacgataaacccggttggatagcacaacgagatgactttttagctaggctagatcctcaaacggcaaaagcactcgcctggagattcgctgatgacgcaggcgaaagggtagcacgcaaatcagctgaagacgaggatcaaggattcttacctagacaattaactgacacagggtatatcgcgcgagtggcattacgatacctctcgttagttactaacgaacccaacgcagtggtcgcaaccaacggccgtcttacgggcttattaagactggcatgggacatcacaccgggtccagctccaagagatcttctaccaacgcctcgcgacgccttaagagacgatactgccgcaaggagatttctagacggattaacaccacccccattagcaaaagcagtagaaggcgcagtacaagctcgacttgcagcattaggaagaagtcgagttgctgacgcaggactagctgatgcacttggtctaacccttgcctcattaggaggaggtggtaaaaatcgagcagaccatcgacaccattttattgatgccgcaatgatagctgtgacaactaggggattgattaatcaaataaatcaggcaagtggagcaggacgaattttggatttaagaaaatggccaagaactaactttgaaccaccctatccaacgtttagagctgaagtcatgaaacaatgggatcatattcatccatctattcgccccgctcacagggatggtgggtccttacatgcagcaactgtatttggagtgagaaatagacccgacgcaagagtattagtccaaaggaaaccagtcgaaaaattatttcttgatgctaatgcaaaacctttaccagctgataaaatagcggaaatcattgatggatttgcatcaccaagaatggcgaaaagattcaaagcactcttagctcgatatcaagccgcgcatcctgaagttcctccagccctggcagcattggctgtagccagagaccctgcatttgggccgagaggtatgacagcgaacactgtaatagcgggaagatctgacggagacggagaagacgcaggattaataacaccatttagagcgaatccaaaagccgcagtgaggacaatgggaaacgccgtatatgaagtctgggaaatacaagtaaaaggacgtcctagatggacacacagagttttaacgagatttgataggacacaaccagcaccacctcctcctccggaaaacgctagattagttatgagattaagaagaggagatttggtatattggccattggaatcaggagacagactattcttagtaaagaaaatggcagtagatgggcgactagcattatggcccgcaagattagcaacaggaaaagctactgcactctacgcacaactctcatgtccgaatataaacctcaatggtgaccaaggttactgtgtacaaagtgcagaaggaattagaaaagagaaaattagaactacctcttgcactgcattaggaagattaagactatctaagaaagcaacatga

SEQ ID NO: 5188 - RNA, 3525 nt, synthetic construct
  misc_feature 1..3525: note = Cas9 variant
  source 1..3525: mol_type = other RNA
atgggaaagtattcgattggacttgacataggtataagttctgtaggatggtccataattgacatcgaaaaaaagaaaatagtagacttaggaagcagaatttttccctcgggaaatgccgcagccaatcaagatcgcagaggctatagaggcacaagacgactaattagacgtcgcaaaaaccgactcgcagacgtaataaacttcctcggcgaagaaaacttcatagacacaaaagttgtggaccagaatgggaacatacattataaactactagtaaactctacagaatcaccatataaactaagagttaaaggcctaagtaaaatgctaacaaaacaagaattagtaatagcactctatcacatagtcaaacacagagggataagctatgatttaggagacctagaagatgatggaacttcaggagtcacagactacaaaacaagcataaacataaaccgacaattactaataaaaaagacagttggacaaatacaacttgagagattaaaggaattcggtaaagtgcgaggccacgtaaaaaaggacgaaaacatcaccctactcaatgtattcccttcatcagcttatgttaaagaagccacacaaatactgactaaacaaagagaattctaccccgaaataaccgacgattttataacgaaatttatacctttcatatcaagaaaaagagattatttcgtgggtccaggcaacgaaaaaagccgtacagattatgggatatacaagaaagatggcagaacactagacaacctattcgatgaactcataggtatagataaaatctctggagaaaaaagagcttctgcatcttcagtgacagcccaaatatataatatgttaaatgacctaaataacctaacagtgacaaacacagaagacggcaaactaacaacacaaacaaaacgtgaaatcattgaagcagacaaaactactaacggactttttggaataacacagatctgcaaaataatcggatgtaaaaaggacgacataaaaggattcagaatagataaagtagaaaagccaataatgcacacactaagcggatatagacgattcagaaaggaattagcaaaaataaacatcgaagctaacgacttagatatcaatttagttaacaagatcgctgacatactaaccttaaacaccgaaaaagccgaaatacgtaaacaactaaacaaaagcaatatcgatgtctccaatgaaatcaaagaacttataattaacaagaacaaggatttcctagtcgatggacgagctacttggcatagtttcagctataaaacacttaacctacttataccagagttgatgaacacaagtgaagaacaaataaccatcctaacaagactaggattagttaaatctaactctgaaaaatacaaaggcttaaaaaatatcccagccaggaggataactgaaggcatttataatcctgtagttgcaaaagctacacgcgaagctgtaaatgtattcaatgcaatagcaaaaaaaatcggacgagataacatctcagatgttgtaatcgagttaccacgagaagacaatgaagcagacataaaaaaaggtatagtaaaaagacaaaaacaaaacgaattagaaaaagaagcagcggacgctctagttaaacaacagatgaccatatcagacagtgcgctagtagcacactatagaaaagttcgcgggctgtcacaaaaagtaagatattggtaccaacaaggtacctgttgcccatactgcggcaaaaatatagaagcggtccaattaataaacaacaatgattcattcgaagtagaccacattataccaatttcagtaagtttcgacgacagtcaaaacaacaaagtactagttcactcacagtgtaaccaagccaaaggtaagcagacaccactaggatggctcaataatggtggaggattcggacagaataaaacagagtacgtcgcaaaagtaaaaacaaacaaaaactacagtaaaaataagatggataacttactcaacgacatggatctatctgatatagttacacaaagagggttcattcaacggaatctaaacgataccagatacgcaagtcggatagtattagatgaattttactcattctttaaatcaaataacctatcaacaaaagtcaaaatagtaaggggtaaatggacttcacaaatgagaaaaaaatggaacggagtaggcggactaaaaaaaaccagagatacgtaccatcaccatgcaattgacgcatccataatcgcaagttttccactactaaaggtctttgataaagctataaaattaatagatatagacagagaaacaggagaaatactacaagacaaagaagcaattaaaatgtcgcaagaagcgaagttattagaaaaaatacctgtaatacaaaatgaaaaatttgaagaactaataaacgaattatacgactttccacttttcaaacaagtagaattagccaacgatataaccaaccccgaaaaccccgtgaaattcagccatcacgtcgataaaaaagccaacagaagcgtagcgaaccaaacaatctatggcacgagaataaaagaaaaagaaataaataaacgaggaaaagtagagaaagtacaggaacgttatatattaggtacaataaaaaacatatatgacatagacagctttacctcattcaaaaaaatatacgacaagatgagtaaaacgggagatgtaaaatttctaatgcaaaaaaaagacccaaaaacctggggaaaactcgtagaaatactaaatagttatcctgacagcgaagaaataacacaagtagatggaaaagtaaagcgcgttaaggtaagcccctttgaactttatcgtcgagaaaatgactttatcacaaaatatgcaaaacacaatgacggaccaaaaatagtatcaataaaatattacgacagcaaaataggatcgcacattgatataacacccatcaatgctaaaaataaagtagttctgcaaagcctaaagccatggagaacagacgtttacttcaactcagaaaccagacagtacgaactattagggttaaaatattccgatttaaaatttacaaacggggtttatggcataaccagcgaagcttacgaaaaattaaaacatggcataagtgaagacggaaccaaaacatggaaaccaattggaaaaaatagtggattcagattttctctatacaggaataacagagtaaagatcgtagatgaaaaaggagaatcattagagctcttgtttgcaagtcggaccaccagcaacgaaggatatgtagaactaaaacccatctacaaatctaaatttgacagtaaagaagacgtgggattttacgggcaaatgacacccagtggacaattcgtcaaaaaaatggccagagtggggtataaactttacaaagtcaacaccgatgtgttaggtaacccatattacataacaaaagaatccgatgatcccgaactaagtttatacaagaaatga

SEQ ID NO: 5189 - RNA, 3528 nt, synthetic construct
  misc_feature 1..3528: note = Cas9 variant
  source 1..3528: mol_type = other RNA
atggaagaaatgaaacaaacaggcaggaaaaatgaagcccccaaattaacagatctaaattatagaattgggctagatataggaatagcaagcgttggatgggcagttctagaaaacaatagccatgacgaaccattcagaataatcgatttaggagtaagaatttttgatacagctgaacagccaaagacaggtgcaagtctagcattacctagaagagaagctagatcagcacgaaggagaatacgaagacggagggatagaatcgaacgtataaagaaactatttcaagcagaaggattgattaacatagacgagttcgaagctagatacaaaattgcaggtttgtcagacgtgtataaattaagatatgaagggctagacagaaaactcacagacgacgaattagcacaagttttattacatatagcaaaacatagaggttttaaatcaacaagtaaagcagaagaagcggaaaacgaaaatgacgctgcgaaaaagaaagaagcaggagctttaaagaaagggatctccaacaataagaaattaatggaagaaaaagggtacaggactgtcggagaaatgatgtacctggatgaaaactttcgaacagactgtccatggaatgaaaatggatatattcttacacctcgtaacaaatcaggtgattacaaacataccgtactaagagatatgttagtggacgaagtaagagaaatattcaaaagccaaagatcgctaggtaatatacatgcctcagaagaactagaaaatgcctatcttgacataatgctatcacagagaagttttgacatggggccaggtgcgccaagcaaatatgcaatggaaggtttcgaggacagggttgggctatgtacatttgaaggtaaaaatggtgaaaaacgcgcagctaaagcagcatatacgagtgaattatttgtagctctcgagaaaatcaatcatacgaaaatcgtgagtgatgatggagcaacgaggtttctaacaacttatgaaagaaaatcaataatagaattaatgcacaaacaacaaacagtgaaatacgcagcggtaagaaaagcaatcggattagcagaagaagacaaattttataacttaaactactccccaaaagcaggatccaagaaatcgccggaagataccgacttcgtaaaattggaaaactaccataaaattagaaaagcattaggtgaagacatagtatctgaacacttaccagctgagaaaataaaactgtatgatagcatagcgactatattaacattattcaaaaacgacgactcaagaataaaaaggtttatagaattaggcataggcgaggaatgtttcgatggactcttaagtttgtcccctagcaaattccataacttatcattagtggccatgggaaaaatcataccattcttattagacggaaacacgtatgataaagcatgtgaactagcaggatatgactttaaagcggataacaaaggcgaaaaatcggtacttctgaaaggaaagaacatcacagacatggtaaatgatataacaaatcctgtagtacgaagatctgtcagccaaacaataaaagtaataaatgcgataatactggaatatggaagcccgcaagcagtgaacatagaattggcaagagagatgagtaaaaattttgacgaaagaagaaagttaaaatccgatatggagagcagagagaaggaaaataataacgtaataaaaagagtgaaagaatacaaactaaatcctaccggtcaggatattgtaaaattcaggctatgggaagaacaagataggaggtgcctatactcgggcgagaaaatcgatattaatgacttattttctagagatggtggatatgacgtagatcatattctaccatatagcataacgttcgacgacacatacaggaataaagtattagtaaaagctagtgaaaatcgacaaaaaggtaaccgaacaccatatgaatacttcatggctgaaaaggatgacgacgagtggaacgtatacgagactctagtgagaaacacagttaaggattataagaaagtcttaaaactcctcaagaaacatattacagaagatgagaaatcagaatttcgagaacgaaaccttacagacacaaaatacatcacacgaatcatttacaatatgatacgacaaaatctagttctcaaaccatatcttagtttagaaaaagaaagaaagaaacaagtgatggcagttaacggaagtataacacattatctaagtaaacgatggggtttagaatcaaaagatagaaggaccgatacacatcatgcacaagatgctgtagtaatcgcctgtactaccgacggaatgattaacaaaatcagcagatatagtaaaggtagagagttactatatagtagaggatttaaatttgtcgatgaagaaacaggagaaatactgtcccgtgacaattttacaagagaggaatgggatgagaaatacggagtaaaaattccaataccctgggaacatttcagggatgaattggatatacgaatgagtagatacaacggtacaggagacgattctatagacaaaacaacaccaagagacttcattttaagccacagagacgcacataaatggataaattatccagaatggatgttcgttgaaggcagacctggaaggaggggagttttagatggaatattcgtaagtcgcatgccaaaacacaaagtcagtggacaagcccatgaagaaacggtaagaagcgctaaatattataatgacggagggtcagtatttgagagtggagggtatgtagtaacaaagaaaagcattcaagatataaaactaaaagacggagaaataaaagagttctttaatccagatagtgacagactattgtacaatgctttagtagacagactaaataaatttgaaaacgatccaaagaaagcatttgccgaaccattttataaacctaaagcagacggcacacaaggaccaatcgtaaagaaaataaaagtatttgaaaaacaaagctcaggagtgttcgtaagagacggcaaaggaatcgctgcgaatggagcaatggtaagaatcgacgtattctgcgaagaagataaaggtaaaaagaaatattattttgttccaatatatacggcagacgtcgtcaaaaagaaattaccagatagagcagctacagctaataaattaataagtgaatggagagtaatgaaagaagaaaactttatattttcattatatagccgagacttaatatacatagaaagtgacaaaggagtccaagttaaagacatagatggaaaaattagcaaacccgtgaatctattcgcatattacctaggggcagacacttcaacggcgtcaataagcggaaaactacatgacagctcggcgaacttcaggtcaataggcatacaaggattaaggcgatttgataaatgtcaagtagatgtattaggaaatatatcatttgttaataaagagaaaagaatgccattcaattga

SEQ ID NO: 5190 - RNA, 3531 nt, synthetic construct
  misc_feature 1..3531: note = Cas9 variant
  source 1..3531: mol_type = other RNA
atgaacaaagttcaggaagactgctataaaaaaataaaagaaaaactagcggatagagaataccgcataggactcgacttaggagtaggctctattggatatgcagtagtatcacttaaaggtgacatgccagaagacgtgatattagcaggaagtagaattttcaaatcatcgattggcgcagcggaacgcagacactttcgagcacaaaggaatactcatcgccaccatagagaaagaatgagatacttatggaaactacttgcggaaaaaaaccttgccctacaactaccagaaaacttaagtaaaaaagagaattttacagattttgatacctcacgaaaacgtttccccatagaagtattaagaaatgatccttacatattaagatataaagcactagacgagaaactctcactattccaacttggatacgctctataccatatagcgaaccaccgcggaaccgccagtgtaagaagtttcctagaagacgacgaagcgaaagttaaagaaaacaaggaaacagcaaaactagcaaaaaacacaaaaaaaataatgtacgaaaaaaagtatcggacattcggagaatacctatacagagaaagaatcgaaaaatttcgacagaatgaacgtatgaaggtcacaaacaaaaatgaaaacaaagaatttgcagtaacccgtgatatcatagaaaaagaagtagaaatgatattaggagcacaaaaacgctacaacacagccgttctagcagacgattatattgaacgaataaaaaaagcaatattttacgaaacggaaaaattgataccagaacccgaatactgcccttacttcaaagatgataaaagactacctagatcacacaaactcaacgaatatagacgcatctacgaagcactaaacaatacaagatactatatcccggaaatagaagaaaaaacaggggaaatactaagcagaaaagaaaaagaacaattaagcaaggaagaaaaagaaaaactatttaacttccttttaaaaaacaaagagctaaccgaagccaaagtcaaaaaattactcaacctctcagaaatggcaaaagttcaacttcagggaagagacaaaaagaaccaaaaaataaaaggctacgcattaataacactagagtcattaccattctggtccaaattacccgaacaacagcaagatgagttcttatacgactggaacaaacttcctgacgaaaaacttaaagatcgattacgaaactattacaaattaactgacgatgaaatagatgaaacatttcaaaacatagtattaccatcaaattacgccccactcggaaaaaaggcaatggaaattcttctggaatacataaaaaacgggctcagttacattgaagcattagacaaagcagctgacgaaaacaaaataaaggttgaaaagcacgaaataaatgacctgttgccatactatggaaaaatactccaagaatcaacacagatgcccataggaaaagccttttccaaacaattcgcagccaaaaattacaaaaaaccagatataaataaaaacgagcaagaatttggaagaatagccaaccctgtcgtacaccaaacattaaatgaattgagaaaattaataaacgaaataataacagtattcggaaaaaaacccctagaaatatcactagaaacaagtcgagaactgaaaaaatctcaaaaggaaagagagctaatagcaaaacaacaagacatagacgaagaaaaaagaaaaaaaatatggaagacatatatagaaccacatttacaacaaataaaaagtaggtcagataaactcaaaaaattgttcgtttttgaactttgggaagatcaaaaacataattgcccattttgtctagaaaaaataaatgttgatgatatatactcacgaggagtagacaaagaacacctgtttccactaaaaaaaagcgaagatgacagcgagaataatctagtgatagcacacaacaaatgcaatgcgagaaaagcggaaagagcgccattcgacgcatttggacatgaaagtatttggaatgatatattcagcaacgcagaaaaaaacttaccaagaaagctatggagattcagacaaggctccttcgaaaagttccttgaaaaaccccctatgctcaaaaggttcgaaactgacaatagctatatcagtaagatatcagcacgatatctagcttgtctttttgacaaaccaagcaaaatattctgtgtgaagccattcctaacagcccaactacgaatagcatggcaactagacgaaataatgattagactagcagaaaatatcatactagactcagaaaaagactcattcaataaaggcggcctacaaaaaaaaaaaaggatagacaacagacaccatgcattagacgctgtggttatagcttatgctagccgaggatatcataacttcttaaaccgagtacatgcgaaaggttacaaaattaattatgatgaaaaaacttggctatctgaaacactgagaccaccgggaaataaaaacctcgaagacttcaaaagcggcataatcaacgttatgataaacgcaaacatatcaataaaacatgaccataataataaaggtcagcttgtcaaaagcaaagcttacaaactctactattcagagatagggaaatatataatcacaacattaaaatcagtatctgagatattattcaaacaaaaagaaaaaccccaagatactttgagaagagcattatgtaaatttgaagatcgtttgagtgatattaaagacaaaaaacttaggaaaaagctcgaagataacattactatttataaatcaatagagaatgaatcagcactctcgaaagcgaaacaagaactagaagaattcgacctaaaagctaaaaaagaaggtaaaaaaggttatgaaaaaattacagatattctaatctataaaaaagcatgctccatgcacggaggcaaatacatacacgtgaaaaaccgaatagagaacaaattctttgctcttaaagagcctactgaaattgagacaggatttggatacgacaccgccgacaacctaagcctagacttataccatgacaacaacggaaaactatgtggtgaagtaattcgaaaaatagacttcaatagaaaccgcgtacccaattataagaaagaaggatatatattacttgaaagaatatatcaaggcgatactctagaagtagacatctcggacgacaaaatttcacttaaaaataaagtaggctcagcgcccgacaaaagaaccttcgtaaaagtactaacattcaccgaatcagatagatacctaaaaaacaagagagaccaaatacaaatattcttctgcaacctattaaaatcaaccttaaaacatgacgattctagcaaacacgacgatagtttttacgtctcaagtatgcaaaaatacaacgttagaaaagtcatactaacaagtctaggaataatcaaatatagatcaaaaattctaaaaaacaaagaaatatga

SEQ ID NO: 5191 - RNA, 3531 nt, synthetic construct
  misc_feature 1..3531: note = Cas9 variant
  source 1..3531: mol_type = other RNA
atgttattcccaaaaaaattaagcaaagaagaagtagcctatgttttagtagaaattaacagcaatttaaataatagttccaactatctcggaaacatatccgatcgatcaaaagaattatacttcaataaacaaactataggccaattcttatacacgaaattaaaagaagacagacactatagtttaaaaaataaagtattctacaggcaagactacttagatgaattcgaacgaatatgggaaacacaagcaatctttcataaagaactcacagaagacctaaaaaaacaaatacgagacacaattatattttaccaacgaagattgaaatcccaaaaaggcctaatatcactatgtgaattcgaaaataaagaaataacaattgaaaaagaaggaaaaaccgtaaccaagcaaataggcgttcgagtcatacccaaatcttctccactattccaagaatttaaaatctggcaaattttaaacaatgttatatgtaaaaaaaaaggaaccagaaaaaaaaaagcagtaaccccagcacccctactattcgaactctttggaactccctcggaaactttcttttctttggatatggaatgcaaacaacttttatttgaagaattaaacctaaaaggaaacttgaaagcagataaagtaatccgactattaggatatataccacaggaatgggaaataaactacaatcaattagaaggaaaccgaacccaaaaatccctatatgaggcatacttaaaaataatagagatcgaaggatatgatataaaaacatttttacgtatcaaatccgacaaagaagactgggacctagaagaatcgcctttaagcgcaaaagaaattcgcgaaaacatacaacacatatttgaaacactaggaatatcaaccgcaatattatacttcgatgcaacattaccaataaaagactttgagaaacaagcctcctatcaactctggcacctattgtactcatatgaatcagacaactccccgtccggtaatgaaacactatataaactcttgcaagataaattcggatttaagcgagaacatgccgtatttctatccaatatctcattccaagatgattacggtagcttaagcgcaaaagcaataagaaaaatatacccatacattaaagaaaatcaatattcgactgcatgtgaattagctggctacagacactcaaaattatctctcacaaaggaagaattaaacaaccgaccattaaaagatttaatatcacccttaaaaaagaattcattacgaaacccagtggtagaaaagggactaaatcaaatgataaacgtagtcaatgccctaatcgaaaaaaactcagaaaaagacgcagaaggaaacataatcaaatacttccacttcgatgaaattagaatagaactagcaagagaactcaagaaaaatgcacaagaaagagccgaaatgacccttaacatcaaaaacgcaactatagaacaagaaaaaatcaaatccatcctaataagcgacttcggcatcaaaaacccgacgaaaaacgatataacaagatacagattataccaagaactcgcacacaatgattataaggatctctacaccaacaccgacattccaaaagaactcttatttagcaaaaatatagacatagagcatatagttccaaaagcaagagtcttcgatgactccttctcaaacaaaaccctcgcgtaccgagacttcaatttaaagaaaggagagaacacagcatttgacttcatcgattctagtctcggagaagaagaactgaatcaatatatagcaagagtagaaaacgcctttaaaactaaaaacataagtgctacaaaatacagaaatctcttaaaaaaagcaacggaaattaacgacggtttcattaatagagatctaagagaaacacaatacattgcaaaaaaagcaaaagatctactatttcaaatcacacgaagtgtagtgtcaacctccggctcaataacagaccgactaagagaagactggggacttattgatattatgaaagagttaaacatgcccaaatacagagacctaggattgacagaaataatcgagagacgagatggacgcaaagtagaagttataaaagattggactaaacgaaacgaccaccggcaccacgcaatggatgcactgacagtggctttcacaaaaccaagctacatacaatatctaaatcatttaaacgcccggaaagacgaaaacaataaattgtacgcagacatactaggaattgaacgaaaggaaacgaccaaaatacatgacgagaatggaaacgaaaaacgagttttcatagaaccaatcccgggcttccgtcaaatagcaaaaaaatatctagaagaaatactaataagtcacaaaacaaaaaataaagtcgtcacaaaatcaataaacaaaatagcgggtacgaataagaaacaagagactctaacacctaggggacaactacacaaagaaactatttacggaaaataccactactattcaaacaaagaagagaaaataggtacaaaattcgataaagaaacaatctcaaaagtatccaacccaatctatagatatgcactacaaaaaagactggaagcaaacgaaaacaacccaaaaaaggcttttacaggcaaaaatgcgctaagtaaaaacccaatctacctagacgatgccaaaacaaaaatattacccgaaaaagttaacctaatatacttagaagaagacttctcaatcagaaaaaaaatagtaagcgaaaaccctacatcaaaagaattcgtacccaacagtataagtatagagaaaatagtggatgaaggaataaaaagaattctaaaggaaagacttgaaacgtacaacaacgatccaaagaaagcattcgcagatttagataaaaaccccatttggctaaataaagaaaagggaatcagcataaaaagggtcacgataagtggagtaaaaaatacacaagcactacatagcaaaaaagatcacttaggaaaaccaattctggataaagaaggacaagaaatcccagtagattttgtatcaaccggtaacaatcatcacgtagcaatttacagagaccaaaaaggaaatctccaagaacagatagttagcttcttcgaagcagtagtaagagctcagcaagggcttcccatcatcgacaaaacctataaacaagaagaaggatggcaatttctattcacaatgaagcaaaacgaaatgttcgtattcccaaatgaaataactggctttaacccatccgaaatagatttattagaccctaaaaataaaaagttaataagtcctaatttatttcgagtacaaaaaatatccattaaagactacttcttccgccaccatctcgaaaccaatgtcgaaacaaacaacatcctgaaagatataacttggaaacgcggtggcctctctctgctaaaaggaattataaaagtacggataaatcaccttggaaacatagtaagcataggagagtattga

SEQ ID NO: 5192 - RNA, 3534 nt, synthetic construct
  misc_feature 1..3534: note = Cas9 variant
  source 1..3534: mol_type = other RNA
atgaataaagtccaggaaatagaatacaaaaaaataaaagaaaaattagcagacagagaatatcgcatcggtctggacttaggcgtcggaagcataggatacgcagtagtatccttaaaaaaatacgacgatttaagctacttaccagaagacataattttagccggttcgagaatattcgcatcatcaataggagcggtagaacgtagagaattcagacttcaacgtaactcacatagacatagacgagaaaggatgagatttctatggaaactactagcagaaaaacagttagcactacaaccatcaaaagacctcgaaaaaaaagaaaatagtgcagactgtgaaacaagccaaaagagattcccaataaacatcctaaaaaacgacccctacatactaaggtacaaagcactcgatgaaaaactttcactcttccaactaggatatgtattataccatgtggctaaccacagaggtacagacagcatccgttcatttcttgaagacacggacgacaaaataaaagaaaataccaaaaccgcaaaattagccactgaaaccaaaaaaataatagactcaaaaaaataccgaacctttggtgaatacctatataaagaacgtatacaacaaaacgaacgaaaaaaagtatctaacagaaaaactgcaggtaacaaaaataaagaatttgcagtaacgagagacatgatattcaaagaaacagaaaaaatccttgccagtcaaaaacaatactatacgaatgtgcttaccgacgagtatataaaagaaatcgagggtgcaatattttaccaaacggaaaaactcatcccagaatcgggttactgcccttatttcaaggacgaaaagaggttaccctgtagtcacaaattaaacgaataccgaagaatatatgaagcactaaacaacgcaagatattccgcacctgtattagacgaaaaaaccggggaaattttaagctatcaagaaggcgaggaattttcgagtgaagaaaaaaaaatactattcgatgaggtcctgctaaaaggaaaaaaacttacagaaagcgaaataaaaaaattacttcatttaccagacggatgcgaaatccaactacaggggagagataaaagaacccaaaaaataaaaggatatgcgcttacagccctcgaagcgctcccattctggagcaaactatcacaacagcaacaagatgaattcctctatgattggaacggactacccgaagaaaaactcaaaccaaaactaattgactgctactcattaacagaaaatgaagtagacgaaacattccaaaagattcgactaccatcaaactacgccccggtcggcaaaaaagcgatggaaatcttactaacttatatcaaagatgggtactcttatactgaagccttggataaagctgtaagtgaaggaaaattcaaagtagataagcaaacgactatttacgattcgttaccctactatggtaaaatcctacaagaatcaacacaaaaactgataggaaaggccttcagcaaacaatttgcaaaacgaaattataaaaaaccaaatacaaaccgaaacgaacgagaattcggaaaaatagcaaatcccgtagttcaccaaagcctaaacgaactacgcaaactcataaacgaaataataacagtattcggtaaaaaaccactggaaattggcctagaaaccgcccgtgaattaaaaaaatccagcaaagatagagaatcgttagtcaagcaacaaaatgaaaacgagtataacagaaacaagatatacaaagattacgttgagccacatctatcacaaataaaatcccgccaagaaaacccaagccggtacatattcaaattcgaactattcgaagaacaaaaatcaatatgcccattttgcctaaaagaaataacccccgacgatataatcaatagcaaagtggacatagaacatatattcccaatagaagaatccgaagacgacgctaaaaataacctagtaatagcacacaatgaatgcaacgcagataaaggaaaaaaaagtccatttgatgcattcggggataaaacctcaggtaaatacgtttggaacgatatacttcacaatgccaaaaaaaacctgccccataagatatggcgtttctatcaaggatctttagaaaaattcttagaaaataaaccaatgctaaaaagattcggaaccgacaatagctacatttctaaaatagccgccaaatacctagcatgtctctttaacaattcatccaaaatcttttgcatcaaatcatcactaaccgcacaattacgaatcgcatgggaattaaactcaatcatgatacctctagcaaaaaacatcctaagcgaaaaggaattggaagaatttaaaacgctcaaaaacaaaaaaatcagaatggacaaccgccaccacgcgctagatgcaatcacaattgcatacgcaaatcgaggatatcataatttcttaaataaaatacatgcaaaaggttacaaaatcgactatcgagaaaaaaactggttaagtaaaattctccttcctccactcaacagagacctcgaagactttaaaatctccgtaaaaaatagtatagaaaaagccaatgttagcataaaacatgatcataaaactaatggatcactcgtgaaaggaactgcatataaagtttactattcaggaaccggtaaatatataattacaacactaaaaaacgtcgaagaaatatcatttaaagaaaaagaagatcctgaagacacactgaggagggcactatgtggatttgaagactccaatataaaagatgaaaaattaataaaaaagctcaaatacaactcagacctctataagaaaatattaaacacaaaaccaaaagcaaaacaagaactagaacaggctaaccaagaaacaaaagaggaaggaaaaaaaacacaaaaaatcaccgacgtactaatatacaaaaaagcctgcagcctagtcggagagcaatacatccaatgtgcatcaagacttgaaaacaaatttttcgcagtaaaagaaccaacagaaatccgaaccggaattggctacgacaccggagacaacttattcctagatctttattacgacaaaacaaggaagttatgcggggagataatcagaaaaatagattttaatcaaaacaaaataccgaattaccaaaaagaaggatacatactattcgaaagaatataccaaggagatacacttgaagcagacacatcagaagacaaaatatccttaaaaaataaaacaggttccgcacttgataatagaacctttgttaaagtactaacgtttacagagtcagacaaatacttcgatggaaaaaaagataaaatacagatcttcttcggcaacctattaaaatcaaactacaaacaagacgactcattctatataagtagtatgcaaaaatacaatgtacgaaaagtaatccttacgagcttaggtataataaaataccgttcacagatactcaaaaacaaggaagtctga

SEQ ID NO: 5193 - RNA, 3540 nt, synthetic construct
  misc_feature 1..3540: note = Cas9 variant
  source 1..3540: mol_type = other RNA
atgagcaaaaaagtttcacgaaggtatgaagaacaagctcaagaaatctgtcaaagactaggctctcgaccatattcaatcggcctagatctaggcgtaggttcaataggggtagcggtggcagcatatgatcccataaaaaaacaaccatcagatcttgtatttgtaagtagtcgcattttcataccatcgactggtgcagcagaacgacgacaaaaacgcggacaaagaaacagcctaagacacagagcgaatagacttaaattcctatggaaattactagcagaaagaaatcttatgctttcttactcagaacaagatgttcccgatccagcaagattacgctttgaagacgcagtagtacgcgctaatccctacgaactaagattaaaaggtctaaatgagcaattaactctctcagaattgggctatgcattatatcacatagcaaatcatcgcggatcatcttcagtaagaactttcctcgatgaagaaaaatcgagtgacgataagaaattagaagaacaacaagctatgaccgaacaattagccaaagagaaaggtatatcaacttttatcgaagttttaactgcattcaatacaaatggattaataggatatagaaatagcgaatcagtaaaatcaaaaggtgttccagtacctactagagatataatatcaaacgaaatagatgtactactacaaactcagaaacaattttatcaagaaatactatcagacgaatattgtgatagaattgtaagtgcaatactttttgaaaatgaaaaaatagtacccgaagctggttgttgtccatacttcccagatgagaaaaagttgcctcgatgtcatttcctaaatgaagaacgaaggctatgggaagctattaacaacgcgagaatcaagatgccgatgcaagaaggagctgccaaaagatatcaatcagcaagtttttctgacgaacaacgacacatactttttcatatagccagatcaggtacagatattacgccaaaactagtacaaaaagaatttcccgcacttaaaacaagtataatcgtgctacagggtaaagaaaaggctatacaaaaaatagcaggttttaggttccgtaggttagaagaaaagagtttttggaagaggctaagtgaggagcaaaaagatgattttttctccgcttggactaatactccagacgacaaaagattaagtaaatatctaatgaaacaccttcttttaacagaaaacgaagtggtagatgcactcaaaacagtaagccttattggcgattacggccccataggcaaaacagcaacccaactactaatgaaacacctcgaggatggactcacttatactgaagcacttgaaagaggaatggaaacgggtgaattccaagaattgtctgtatgggaacaacaatcattgcttccgtattatggccaaatcctaacgggatcaacacaagcattaatgggaaaatattggcactcagctttcaaagaaaaaagagattcagaaggcttctttaaaccaaacactaattcagacgaagaaaaatatgggagaattgcaaaccctgtagtacaccagacattaaatgaactaagaaaactaatgaatgagctaatcactatactcggcgcaaaaccacaagaaattacggtagagttagcacgagaactaaaagtaggggcagagaagcgagaagatatcataaaacaacaaactaaacaagaaaaagaagcagtccttgcttacagcaaatactgtgaaccgaataatctcgacaagagatatatagaaaggtttcgactactagaagatcaagcatttgtctgtccatactgtctagaacacataagcgttgcagatatagcggcaggtagagctgacgttgaccatatctttccacgggacgatacagcggataactcatatggaaataaagttgtcgcacatcgacaatgtaacgatataaaaggtaaaagaacaccctacgcagcatttagtaacacaagtgcctggggtcctataatgcactatcttgatgaaacacctggaatgtggcgcaaaaggcgaaaatttgaaacgaatgaagaagaatacgcaaaatatcttcaaagcaaaggttttgtaagtcgattcgaaagtgataatagctacatagctaaagcagcaaaggaatatctaaggtgtttatttaaccccaataatgtcacagcggtcggaagtttgaaaggtatggaaacctcaatactacgtaaagcatggaatctacaaggaatagatgatttactaggatccagacattggagtaaagatgcagatactagccctacaatgagaaaaaacagagatgataatcgacatcacggcttagacgcgatagtagccttatattgttccagatcattagtgcaaatgattaacacgatgtcagaacaagggaaaagagcagtcgagatagaagctatgattcctattccaggatacgcatcagaaccaaacctaagctttgaagctcaacgcgagctattcagaaaaaaaatactagaattcatggatctacacgcatttgtctcgatgaaaaccgataatgatgccaatggagcactattaaaagataccgtttactcaatattaggtgccgacactcagggggaggacttagtgtttgtagttaagaagaaaataaaagatattggggtaaaaataggagactatgaagaagtagccagtgcaattaggggaagaatcaccgacaaacaaccaaaatggtatccaatggaaatgaaagataaaatagaacagctgcagagcaaaaacgaagctgcactacaaaaatacaaagaaagcctagtacaagcagcagcagtcttagaagaatcaaatagaaagctaatagaatcaggaaaaaaacctattcaattatcagaaaaaaccataagtaaaaaagctttagagctagtaggcggatactattacttaattagtaataacaaaagaacaaaaacattcgttgtaaaagaaccttccaatgaagtaaaaggattcgcattcgatacgggttccaacttatgtttagatttttatcacgatgcccaaggaaagttatgtggagaaataattcgtaaaatacaagcaatgaaccccagctataaaccagcatatatgaaacaaggatactcactatatgtgagactatatcaaggagatgtatgtgaattgagggcaagcgatctaacagaagccgaatcaaacctggccaaaacaacacatgttagattaccaaacgcaaaaccagggaggacatttgtaataataatcacgttcacagagatgggatctgggtatcaaatatatttttcaaacttagcaaagagtaagaaaggtcaagatacctccttcaccttgaccaccattaaaaattatgacgtgagaaaagtccagctctcatcagctggcctcgttagatatgtatctccattacttgtagataaaatagagaaagatgaagtagctctatgtggtgaatga

SEQ ID NO: 5194 - RNA, 3567 nt, synthetic construct
  misc_feature 1..3567: note = Cas9 variant
  source 1..3567: mol_type = other RNA
atgaaatatatattaggattagacatcggagtctcatccgtaggaatagcagtaatttccgaagaaaaccaaaagaaaactatcgaaaacctagcagtcagaattgtacctgaagatccggatttccatggtaaattctattctggtaatacagcaagtaaaaaccttgaacgcaccgctaaaagagggaaccgtaaaaacaaccaaagattcaaagccagaagagataaattataccaatcattaaaagaaaacaacatgttcccaacatcaaacctatttgacctatctgcagtcgaactatatggattaagagcaaaagcggtaagtgaacaagtatcactacaagaattaggaagaatactaatattactaaatcaaagaagaggatttctaagtaatcgcaaatccgtatctgaagaaaacagcacagaatacaaagaacgcattgctggattagaaaaagcattaggaaataaaactataggacaaaaattatattctgaattacaagaaaacaacaatgtattcgaggtattattgcgagaaagaacataccaaagatcaagttatacggaagagttcgatagaatatgggatgaacagaagaaatattatctaatcttaacaggaagctcaaacgaagatgacaataaaggaactctttatgatctaattcgaaataggataatatactaccaaagaccattaaaatcacaaaaaggactgattagcgaatgtctattcgaaaaacaccacaaagccgtagcaaaaagcagcccttacttcgaactatttcgaatatggcagaaaatcaacgatctatcctggaaaacaccaaacggagaactattcaaaccaacagacgaacaaaaacaaaaactcaaaaatgccctatggaatggtgacaatttaaatcccaaacataaattaaccgtctctaaaatcaaagagattctagggtacacatcaagagagaaaatttacttaaattttacagaactagacggttctcgtacatactcaatcctaagaaacgccctaatcgaggctggcatagaaaaaccagaacaatatctcttctttaacatggaaacaaatgacgaaaaagggggcctcttcgaactctggcatataacttattcactaccaatagaaaaagaagtaataaatgcacttaaaaatagatttggatttgacaagaaacaagcagaaataatagcaagacgcgtaggttacagtagcgattacggcagcctatccacaagagcaataagaaaattattggtccatttagaaaaaggactcggatacaccgacgcatgcgataacatcggctacgatcattcaggatacaaaacaaaaattgatctacaacccaaacttaaacaactaaaacgaaacgagcttagaaatccagtcgtagagcaaatactaaaccaagtagtaaacgccgtaaacttaataatagaaaaatatggaaaaatagacgaaatacgcgtagaattagccagagaactcaggaacaacgcaaaaacacggaaaaacatctcactgcttaacagcaaaaataagaaaaacaacgacataataaggaagaaattacaagaagaatatggatttaaattcgtaaatggaagagacgttacaagatatatactatgggaagaaaactcgaaagaatgtttatactgcaacaaaacaataaacggatcagacatgttaacgggtaatgccgacatagaacatatactgcccaaatcaagaagtttcaataatgctatgaacaattacatcataactcatagaaagtgcaattcagacaagggacagaaaaccgcgtacgactttatgagctcaaaaggcgaagttatattgcaacaatacatagagaaagtaaacgacctatacaaagatggcaaagggtcaataagcaaaacaaaatttgaaaatctactatgcaaaggcgaagacattccttcagacttcgtagaaagaatgaagaaagattcgcaatatatagcaaaagaagcagtcaaaatgttgaaaacagtttgtcctaatgtatacaccacgacgggacaagtaacggatttcctcagagaagaatggaaattgaaaaacctactacaagagctaaccttcgaaaaatacaaagcaataggccaagttaaagagaaaataataaaaacaaataacggacaaacgaaaacatttaaagtgatagctgattggagtaaaagagatgatcatagacatcacgccatagacgcactcatatgtgcactaacagaccagaaaataatatttaaactaaacaacctaaacaaaatataccaatatgaacgaaatgccctaagtcaaaaagaaatcgaagaaatcgaagaatttctggaaggaaaatttagtataaaagaatttagtgctcaacaaggaaacataatagaatgcagtataccaaatatacgcaaagacgcacaaaaacacttagaaaacattctgatatcgttcaagaaagaaaattccaaagtattgaccatgaacagaaaccaacccaaaaattgtaaagaacaaataacttgggtaccacgcgcacgactccatgaagacaccataatggggagggttaaaagaatcccagaaaagaaaatgaaattaaatgataaagtatcattcgaacaaataaaaatgatagtaaacccagaaatcaaagaaatactcttatacagactcgcaaaatttggagacaacccaaaagtggcttttgcaactaaagcattaaagaaagaacccatattttacagggaaaatgaactcaaagaagtctcaatatacgaatgggttaatacaaaacgtgtggcacttaacgaaaacataaccgattcccaaatagagaaaattatagaccaagcatcaaaaagagccgttaaagaaagactcaacggcggaaagataaaagaagtattcaaaaacctaacagaaaacccaatacaactcaaaaacggcatgatactcaaaaatgtaaccgttactgatgaaagtaaggtagagaaaataagaaacggattcgcaataaccggcaaaaaccatcacgcattagtatataaagatgaaaatggaaaatataatgacaaagtagtttcattttgggaagcggtagcaatcggattaagaaacgtaacagagtatggaaacccatatccaataataaacagaaaccataatgacgaactcggagaattttacttcagcatgcaaattaacgacctgtttgtctttgacttgaaacattcagaaaatccacaagaagaaaacgagataaactttttcgacgtagaaaatcgcaaacaaatatccgataaattattcagagtacagaaaatgagcaaaaagagtaatggacaatttgtgtccgactttagacatcacctcgaaacatcagtaattagaaatgatatgattctcaaaaatataacctggataagtataagcaaaaattcggacctcgagcgcctcaccaaaattagagtcaaccacttaggcgaaatcataaaagtaggagaatga

SEQ ID NO: 5195 - RNA, 3585 nt, synthetic construct
  misc_feature 1..3585: note = Cas9 variant
  source 1..3585: mol_type = other RNA
atggacttcactgctgacgtctccgaattaaatgaatcctttatgcagatacatacggaatcaaaatttgaaattgataccgcaaaagtacaagaaatttcacaattgctactggacaacaaaataacaagaatggacagacaaaaacaagtcgcaaacgtcctagcaaaaaactccggcgacaaggaagcagacaaaataaataaaaaaatcgccaccgaattttgcaaggctgtacttgggaacaaagcaaaattcaacgtaatattaggagaagatgcggtagatagtgactggtcattcaaaatggacgatgaaaacagcgatgaggaaatcgaaatcctcatgggacaaactaatggacaacaacagaatgtgttgaggataatacaccaatggtattcccaaataactttaaatggaatagtgccagacggacaaatgatatcggaatccatgatcgacaaatatgaattgcacagaaagcatttattattactgaaacaacaaataaaagtaacaaaagacaaaaaaaaagcacagcaattacatgaagcatacgaacaatatgtccacggaacaggagccaaaaaaaaattaacacaagacgatttctattcaaaagttaccaaaaatttagaaacaagtgacttctcagacgaaattaaaaaacaaatcaatgcagaaacatttatgccaaaacagcgaacatcagcaaatggagtgataccgcatcaactgcaccaacaagaattagacaaaataattgaaaagcaagccaagtattatccttttttagcagaactaaaccctgacaccaaaaggcaaaacatagcaaaatataaattagacgaactaatagctttcaaaataccctactacgtaggcccattaataacaacagaagatcagaagaaaacaagcggtaaaagtttcgcctggatggtaagaaaagaaccaggcaaaataactccatggaactttgatcaaaaagtagacaaaatggcaagcgcagaccaatttataagaagaatgactacgaaagactcataccttataaccgaagacgtactaccagcggaaagtctgatatatcaaaaatataaagtcctaaatgaattaaacatgataagagtcaacggaaacaaattaacaaaacatgacaaacaaaacatatatcaacaagttttcgaaaaatataaaactgttaacgtaaaaaaagttcaaaattacttcctaactgatggacgatatcaacatgctccaaaaataaccggattaagtgatgacaacaaatttaattcaaatctctcgacctatatagacttcaaaaaaatcttccaagatgtagtagacgatcctcaaaaacaaaaagattttgaacgaataatcgaatggtcaacaatctttgaagatagacacatctatgaagtaaaattaaaagaaatcagttggcttaatgatgagcaacgaaaagaattaaagaaaaaaagacatcaaggatggggccgtctatcagccaaactactaacaggaatctttgatgaaaacggttactcaataatggatcaactatggaacacgcagaaaaacttcatgcaaatacaagcagaagaaggattcaacaaaaaaattcaagcagaaaacagcaaacatttagaaaaaaacgatttcgaggacatacttgaagatgcctacacttcacctcaaaataaaaaagctatccggcaagtaatcaaagtagtagaagacatacaaaaaacaatggggacagcacctcagaagatatccattgaattcacacggtcagccgataaaaacccgcgacgaagcatagaaagacaaagacaattagaagaaatctactacaatgacgcaaaagaaatagtaagcgaaggcatgcaagacaacttacaaaactttacagacaacaagcagacccttactgacaaatacttcctgtattttacccaactaggtatcgacatgtacaccggaaaaaaaataaatatcgatgaaatcggtaattaccaaattgatcacatactaccacaagccttcataaaagacgactctatagataataaagtactcgtcagctcagcaataaacaatgggaaatcagacaatgtaccactctcaatgtatgcatccgtcagaatcaaatcagaagtgcaaaacaaatggaagaacttcgcagaacacggcctaatatcccaaagaaaactaaataatttaatgacagatccagaaagtatagataaatataaggcacgcggttttattaaacggcaactagtagaaacctcacaagtaatacgacttgtcgccgaaatcttaaatgagaaatatcaaggagaaacagaaataattgaagtcagagcaaaaatgaacagccaattacgaaaagacttcgatctacttaaaaacagaaatgtgaatgattaccatcacgccttagatgcgtacctaacgacattcatcggtaattacctctaccgcagatacccaaaattgcgatcctattttacttatggtcatttcaaaaagatagacgacgctaaattaaaacagttcaattttttacacgacatagaaaatgacaaagaccccaaatacgtgaatgacaatggtgaactactctgggaccgggaaaaagatatcgcgtattttaaaaaaatatataacttcaaatatatgctagtatcacatgaagtatcaacaagacaaggagcaatgtttaaacaaacaatattcccagcagccgcggatgccaaatcaaagttgataccaataaaaaacgataaaccaacagcgatatatggtggatatacaaataacaacgacgcatatctagctataataaaacttgcaaaaacaggtcaatttaaagtagtcggagttccacagcgagcaatagtcaaacttaaacaggcctatgacaaagaaactggcgattattcaaacgttctttataaagtactggaaccaaaatttgttaaaaaaaaagtaaacagaaaaactggagaaatcacataccaagttgaaaaatttaaaatagtagtcccgaaagtgccatacagacagctagttatagacggcgatcaaaaattcatgcttggatccagcacatataaatacaacgctaaacaacttgtactatctgaaaatgccatcaaaatattagacaaaaaaagcttcgatcaatctggatataaatcaagcgacctcgataccgtatacgacgaaatactaagccaagtcgatagatacttttcaatgtatgataaaaacaaattcagagaaggtctccataatggtaaaaaatatttccaacgattgcccatgatagataatgtagaaaagggcaaaataaaagaaaatggaaaatttaagctcttgaatgaaatactaattggattacatgcaaatccctcctttggaaatttaaaaagcctaggcatatctacacccttcggaatgatgcaattcgcttcaggaataagcttatcggaaaatgccatcctatgctaccaaagcccgactggcatattcgaacgcagagttgcattaaaagatctatga

SEQ ID NO: 5196 - RNA, 3588 nt, synthetic construct
  misc_feature 1..3588: note = Cas9 variant
  source 1..3588: mol_type = other RNA
atgcaaaagaatataaacacaaaacaaaatcacatatatattaaacaagcacagaaaatcaaagaaaaactaggtgataaaccctatcgaataggactagacttaggcgtaggttcgatcggatttgcaatagtaagtatggaagaaaatgacggaaatgtcctattaccaaaagaaatcattatggtaggaagtagaatcttcaaagcaagtgcaggagccgcagatagaaaactttctcgaggacaaagaaacaatcataggcacacccgagaacggatgcgctatctatggaaagtcttggccgaacaaaaactagcactacctgtgcctgcagacctcgacagaaaagaaaattcttccgagggagaaacaagcgcaaaaagattcctaggagacgtgttacaaaaagacatatacgagctacgagttaaatctctagacgagcgattaagtctacaagagctggggtacgtgttataccatatagcaggtcacagaggatctagcgcaatacgtacatttgaaaacgactctgaagaagcacaaaaagaaaataccgaaaacaaaaagattgcaggaaatatcaaaagactaatggcgaagaaaaactacaggacctacggtgaatacctatataaagaatttttcgaaaacaaagaaaaacacaaaagagagaaaatatcgaacgcagcaaataaccataaatttagcccaacaagagacttagtcataaaagaagcggaagcaatacttaagaaacaagcaggaaaagatggatttcacaaagaattaaccgaagaatacatagaaaaactcaccaaagctataggatatgaatccgaaaaactcatcccggaaagcggattttgcccctatcttaaagacgagaaaagactacctgcatctcacaagttaaatgaagaaagaagactatgggaaacattaaacaacgcaaggtactcagatcccatcgttgacatagtcacaggagaaatcacaggatattatgaaaaacaatttactaaagaacaaaaacaaaaattattcgactaccttttaacaggtagtgaactaacgccggctcaaacaaagaaattactaggtttgaaaaatacaaacttcgaagacataatattacaaggtagagataagaaagcacagaaaataaaaggatacaaactaattaaattagaaagtatgcctttctgggcaagactatccgaagcgcaacaagattcattcctatacgactggaactcatgtccagacgaaaaactactaacagaaaaactaagtaatgaatatcacctaacagaagaggaaatcgataatgcattcaacgaaatagtactaagtagttcatatgctccattaggaaaatcagcaatgttaattatcttagagaaaataaagaatgacttatcctatactgaagcagtagaagaagcactaaaagaaggaaaactaactaaagaaaaacaagcaataaaagatagactcccatactacggcgcagtattacaagaaagtactcagaaaattatagcaaaaggattcagtccacaatttaaagataagggttataaaacgccacatacaaataagtatgaattggaatacggaagaatagcaaatccagttgtacatcaaacgcttaacgaattacgcaaacttgtaaacgaaataatagacatcctgggtaaaaagccttgcgaaatcggattagaaaccgcacgagaactaaagaaaagcgcagaagatagaagtaaactgtcaagagaacaaaacgacaacgaatcaaatagaaacagaatatatgaaatttatatacgaccgcaacaacaagtaataataactagaagagaaaacccaagaaactatatccttaaattcgagctattagaagaacaaaaatcccaatgtcctttttgtggcggacaaataagtccaaatgacattataaataaccaagccgacatagaacacctattcccaattgcggaatctgaagacaatggaagaaacaacttagtgatatcccattcagcgtgcaatgctgataaagcaaaaagaagcccctgggcagcattcgcctcagccgcgaaagatagcaaatatgactataaccgaatattaagtaatgtaaaggaaaacatcccacacaaagcctggagattcaatcaaggagcatttgaaaaattcattgaaaataaaccgatggcggcacgatttaaaacagacaatagctacattagcaaagtcgcacacaaatatctagcctgcctattcgagaaaccgaatataatatgtgtaaaagggtctctaacggctcaacttcggatggcttggggactacaaggcctgatgatacctttcgcaaaacaactcataacagaaaaagaatcagaatcatttaataaggacgtaaactcaaataagaaaatcagacttgataatagacatcacgcactcgacgcaatagtcatcgcctatgcatcacgaggatacggaaatcttctcaataaaatggcgggcaaagattacaaaataaactactcagaacggaactggctaagtaaaatccttctacctccaaacaatatagtttgggaaaacatagacgcagacctggagagctttgaaagtagtgtaaaaacagcactcaaaaacgcctttataagtgtaaaacacgatcactccgataatggcgagcttgtaaaaggaacaatgtacaaaatattctactccgaacgaggttacacattaacgacttacaagaaactatcagcattaaaattaacagacccgcagaaaaagaaaacaccaaaagattttctagaaacagcgttgttaaaatttaaaggtcgcgagtctgaaatgaaaaacgagaaaattaaaagcgcaatagaaaataacaaacgattatttgatgtaatacaagacaacttagaaaaagcaaagaaattactggaggaagaaaatgagaaaagcaaagcagaaggaaagaaagagaaaaatataaatgacgcatcaatctaccaaaaagctataagcctctctggagacaaatacgttcaactaagtaagaaagaacccggcaaattctttgccatctcaaaaccaactccaaccactacaggatatggatatgataccggagattcactctgcgtcgacctatattacgacaacaaaggcaaactttgcggagaaataattcgaaaaatagatgctcaacagaaaaacccactgaaatacaaagaacaaggatttaccctatttgagcgaatatatgggggcgacatacttgaagtagattttgatatacatagtgacaaaaactccttcagaaacaatactggaagcgccccagaaaacagagtctttataaaagtaggtacattcacagaaattaccaataacaacatacaaatatggtttggtaacataataaaaagcaccggtggacaagacgacagtttcacgataaactcaatgcagcaatacaatccaagaaaattaatacttagctcatgtggatttataaaatataggtccccaatattaaagaacaaagaaggatga

SEQ ID NO: 5197 - RNA, 3594 nt, synthetic construct
  misc_feature 1..3594: note = Cas9 variant
  source 1..3594: mol_type = other RNA
atgagtaaacatgtcttaggactagacctaggagtaggatcaataggatggtgtcttatagcattagacgaacaagatcaaccggctgaaatcttaggaatggggtcaagaattgtccccctgacgacagatgaccttaatgagttctcccaaggaaaagcaatcagcaaaaaccaaaaacgcacaacacaaaggactataagaaaaggcctagaccgataccaattaagaaggaaagtactttccgaaaaactagcagggcatggcatgcttccagacaaagatctcatgcagttgccagtattagacctatgggaattacgtgcaagagccgctagcccaggagaaaaattatcattgccagaaataggtagggtactataccacattaatcagaaaaggggctataaacacgctaaatcagatgaagcagaagaagtaactaaacgaggcaaagaacaaggctatgtagcaacagtcaaagggagatacgctgaactacaaagagaaggagcgacggtaggtcaacactttgcatgcaaattaaaagaacacagacaagaaagtccttctggcggattcttttataattataggatcaaagatcaagtttacccccgtgaagcatatattgaagaatttgacaggataatggaagtacaaagtgtattttatccagaagtgctaacccctgcttttatacaagaactacgagataaagtcatattcttccaaaggcccctaaaatcttgtaaaggattagtaagtttctgtgaatttgaaaaacaagagagagtggtacaattaaaaagagttaatagagaaggtaaagaagaattgcaagaaagaaaaattacaattggtccaaaggtagcaccgaaaagttcacccatagcacaactctgtaaattatgggaatcaatacataacataagaatttattatccagacggcaaagaaaggccgattacactagaggaaaagagaaaattactagcgtacttacaaacacatgataagttaacattcacagcattaaagaaagaattaaaaataagcgacaaagaaagattgtggtgtgataaattactcaaaggaggaataaaaggagatactacgagagttttactaagaaaagcattagctggatacaagagatacgaacccttacttcggatggacttagagctcagagacttccaagagatagtctcaggtaaacgattgattagaccaatcgtagacgaatcgtaccttagccagcctctgtatagactatggcatatcctatatagcatcgaggaaagagaagctatgcgcagagctctcattgaccaattaggatttcttgaagaagatttagacggaggactacttgacaaattatatcaaattgacttcgcaaagcagggatacagcaacaagagtgccaaatttatttgtaaacttctaccccacctacaaggtggccacgggtattctcaagcatgcgaattagcaggaaaaagacactcagcaggaagtttgacaaaagaagagttagaagaaagacccctgttagaacatataccattattacaatgtaatgaacttagacaaccaatagtagagaaaattttaaaccaaatgatcaatttggtaaatgcactacgccagaaatatggcagtattgatgaagtaagggtagaactcgcaagagaattgaaaatgtcgagggaagaaagagaagaaacaagtaaaaggatcagaagcagagaaaaggaaaacaaagaaatagcagaaagaattaaagaatacgaactatacccaactaaatcacgcattcaaaaatatagactatggcaggaagccggagaacaatgtttatattgcggaagatcaattgatgtagtacaatttctaagaggtgatggagttgaaatagaacatattatcccaaaatcaatactatatgacgactcttccgctaataaaacctgcgcttgtagtcggtgcaataaagataaaggtaacagaaccgcctatgaatatattctagcagagggtagagaagccgaatacttagaccgacttgaaacgttgttccacgacggaaaactaagttattcgaaaaggagacgacttcaatggaagaaagcagacatcccagttgacttcatagaaagacaactcagattaacacaatacatagctcgtcaagcacaagaaatcttaagacaaggaatacgaagagtaggtgctagcgaaggaagtgtcacagcaaaactgagacatttatggggttacgacgatattttaagggagctaaacttcgaacggtaccaaagtatgggagagacggaaatcgtatctcaggaagagaaagatggttctattacaaaaagtgagagaattaaagactggtcaaaaaggaaggaccatagacaccatgcaatcgatgctttggtagtagcttgtaccagacaagggtatatacaaagactaaatagccttaactcagaagaagacagtttacaaatgcaagaagatagcaaacaaatgagagagaaaatgggcggccaaaagagaccaacggcagataaacattcgatattagaaaactggctaatacttcaaccacacttcagtcatcaagaagtaaaaagcaaagtcgccgaaatattagtcagttttagacccgggaaaagaacagtatccacaggcagaaatacatacctacgatctggaaagaaagtaacacagagcggggtattaatacccagaggacccttatccgaagaaagcctatatggacaaatacttaggaatggcgaaccaacctatgtaaagaaagtagcactagaatcgttgtccgaagcacaaatagaacaaatagtggacccaaaactacgcagagaaatggtagctcgtacacagccaagtgagggagctaaattaaatccaaaattactacttgctacaccattctacagcgacgcggcaggtacacaacgtgtacgcagtgtaagggtcgcaatagagaacggcaaaaactctatagtaccactacggtataacgaatcaggaaaagctataacattcgttaaccctggaaataatcaccatgttggaatctacagaacgtctgaaggcaaattagtagaatcctgcgtcactttctggcaggcagtagatcgagtacgctatggaataccaacaataattcgcaaacctagagaagtattagatcaacttcttctcagagacgacatacccgaagcattattagcacatctaccagcgtcagactgggagttcgttgaatacttacaagctaacgaaatgtttttaataggtctaactgacgaagaaatacaaacagcattagcggaatcggatttattaacattatccaatcacctatatcgcgttcagaaaatgtctagcgaatactatgtatttcggtatcatctagaaacagaagtagcagacaacaaaaataatacaggtataattccaaaattctacagactccgagggccaaatgatacatatctaaaagctaatccaagaaaagtaaaagttaatcttttaggagaaataagcctaccttga

SEQ ID NO: 5198 - RNA, 3615 nt, synthetic construct
  misc_feature 1..3615: note = Cas9 variant
  source 1..3615: mol_type = other RNA
atggaaagaatactaggaatagataccggcacaaactcactaggatgggcaatagttgataaagacgaaaatcaatatcaccttgtagcaaaaggtacaaatatattcagtgaaggagtaaagattgaaaaaggcatagaatccagcaaagcagcagaacgaacagaacatagatcagttaggaaacattattggagacgtaaaatacgaaaaataagactcttaacaatactttcagataacgatctatgtccaagactaaaacacgaacaactacgtcaatggagattgaaaaaggtatacccaacggacgacacatttatggaatggcagagaacagaggacaaggcgcaagtaaatccatataaattcagatatatttgtttaacacaaaaactagatctatccgacatcacacaacgttttatcctcggtcgagcactttaccatctaaatcaaagacggggcttcctatcaaacagaaaagaagctacaaaagaaagtgaaggtacagtaaaagagggaatatcatccctgtcaaaagatatgaaggactcaggatgcgaatatctgggagagtatttctaccaattatatcaacaaggcaagaagataagaaaccactacacagcacgtaaagaacactacctaaaagagttcaaagcaatctgctcaaaacaagaattagacgacgcattaatcgaaaagctggaaaaagccatattcgaccaaagacccttaaaatcccaaaaaggacaggtagggacatgcacattcgaaaaaggtaagagccgatgcccaagcagccacccactctatgaagactttagaatgtactcatttatcaataacatcaaagtacaggttgataccctatatgacaaaggagaacgatcattgacagatgaggaaaaacaattaataatacccttattcaaaagaaaatctaaacgcacgtttccattcgaggatatagctaagaaaatagctggtaaaaacaactactgctatataaaatcaaacgaggaaaaggcttataaatttaactaccaaatggacacccaagtaagtggaagccctgtcaacgcacaattagaagagatattcggagaagattggctttcctccgtttgcgaggtgtacactttggcaaacaataaaagtagattccaaataatgaacgatgtatggcacgtacttttcttttacgacgacgaagacaaactaaaagagttcgcaaaagaccgtcttcaactagacgatgaattagcagaaaaattctcaaaaatcagtattcccaatgattatgctgcattaagcctaaaagcaatacggaaaataatgccatatttaagagactatggattaatttattcagaagcagtatttctcgcaaatttagtagatgtactaccacaacatgtatggggaatcaaagaaatgcgagaagcggcaatagaaaatgtgatagatgttatgcacagctatgacaaaaacaatatagacggaataactttagaaggatgcgttaaaacattcctcaaagaaagataccaagtatcagatgacaacctaaagaaactgtatcatccaagcatgttagatccatacccgaggcaacgacctaacgacgaaggagtattccaattaggtagtccacgcataagctcagtcaaaaacccaatggcaatgcactcattattccggctacggaaagtagtaaaccttatgcttaagaaaggttatataacccccgacactaaagtacacatagagttctcacgcgacttaaatgatgccaataaaaggtgggcaatccagacatggcaaagagaaaatgaaaaagaaagagaaagatgcagaaaagaaatagaaaaatacatagcatccccatcagatacagacatattaaaatatcaactatgggaagaacaaaatcataaatgtctatacacaggagacgaaattagaatcaccgacttcttaggagataatcctaaatatgatatagagcacaccatcccaagatcagccggaggcgatagcacaaaaatgaaccttacactatgctcaagcaggtttaacagagatgaaaagaaaacaaaactaccagcagaacttgttaatcacgacgaaatactagaaagaatctccaattggaaagaaaaatacgaagatatagataaacaaatcagaaaaataagcacaaaaggtgcaacatcgaaagaggacaaagactcaaaaataagaagaagacactacttaatactacaaagagactattggagaggcaaataccaaagatttactatgacagaagtaccagaaggtttctcacgaagacaaggaacagatatcagtgtaattagtcgttatgcacgtatgtacctaaaatctgtattcaaacaagtctacatcgtaaaaggaatagcaacctcagatttcagaaaaatgtggggcatccaagatgagtatgccaaaaaggaacgagttaatcatgtacatcactgtatcgatgcaataacaatagcctgtatcggaaaagcggaatacgataaattagcggactaccgccatcaatacgacgattatctcttccaaggaaaaactaaaccaaccttcgataaaccatggccttcatttgtgatagacatcaaacatatacaagacgaactacttatagcacattacgcaaaagacaatctcgaaaaattcaccaagaaaaatttaagaggcaaagacggtagaataatcagagacaaatttggaaacaaattacaaatgaaaggtgacacatctagaaacagcctccacaacgacaaattctatggtgcgattaaccacgaaggtgaaataaaatatgtataccgaactaatatagaagccttagatgccaaaagcataggaaacattgtggacccaacagttagaagcatcatagaatcagcaattgccatacatggcagtctaaaagcagcaatcaataaaggaatatggatgaatgaagaaaaacatataccaataaagaaagtacgcgtcttccgaaatgacgtaaagaaacctatagagttaaaagaccaaagagatctttcagataaagactataaacaacactactatgttactaatgacggaaattacatgatgctaatattcagcaaattaaataataaaggaagagaaataagacaacatgtagtaatcaacagtttagaagcaactgaagtaatcaaaagccataaaagaagccaagtcggaaaagtagtatgggaatcatactacagtaaagaaggcttcgatctaatttacaaattaaaaagtgggactatgatattattatatgaaaacaatagagatgaagtttgggacctagatataagaaacttacagaaaaggctctacatcataacgaagatgaaatacgatgggagaatatacatgatgcaccatcaagaagccagagagaaaaaggacctcgaagaaaagtcaggctcattcaaaataaatgaagattacaggccacttatcgtaaacagctacaaccaattcaacgccttagtgcaagatctcgatttcgaaatcaatgaccttggagagatcagacgtctgatatga

SEQ ID NO: 5199 - RNA, 3630 nt, synthetic construct
  misc_feature 1..3630: note = Cas9 variant
  source 1..3630: mol_type = other RNA
atgaagaaagactacatactcggtttagatataggtatatcatcagtaggatggggattgttagaactggatgacaataataacccctacaaaataatagacgtaggaagtagaatttttactccaggagaagtcgagaaaaccggcgattcaagagcaaaagaaagaagagaaaaacgaggagctcgacgaatcgcacgaagaagagagttcaggcttgacagagtcaaaaacctactctatgaaaatggatacctaaaaggaaacataaactcaaatatagtctccgagaaaaacgaagaactatcaataatatttaataacatgattaataactactacaatggcaaaaacaccaatccatatattttaaaagttgaagcacttgaccgaaaattaacagacgaagaactatctataatcttagtacattacgcaaagaaacgaggctataaaagtaacagagaagaagcaagtgataaagaaagtggaaaagtactaacggcaataaaagaaaatgagaaaataatgaaagacaacaactaccgcaccatttcagaaatgtatataaaagacgataaattcaaaaacaaaatcaaaaacagcccaaatgactataaaatttccgtaacaaatgaaatgtatttagaagaaatcaataaagtactcgacagccaaataaaattcggcctcataacagacgatttcaaaaaccaatatctagaaatatacaactcaagaagatcctacgctaaaggccctggaggaaactccccttatggaggagatctcattgaaagaatgacaggaaaatgtaacttcgacggaaatccgagggcccctaaaagagctttcagcagtgaaatatacgttgcattaacaaaattggtaaacttaaaatacaaagtcaacgacggagaatatatcaaactctcagaaaaagaaatcaaaaacataattgaaaaagcgaaagagaagaaaagtatatcgtacaaagacctcacaaaaatgataggcaataacatcgatttcaaagacctaacattatccaagaaagaatacataaaattaatcgaagaacttaaaaagaaacttaatatcaagaaagatacaaaaatcaacataaacgaactaagttcggaagataaagaattgtataacaaattatgtaacgacaaattactatcaaagacattgatagaactaaaaggataccacatactaaaagactccgttataaaagcatatagcaaagacatatgggatgaagtcaaagacaatatgtacctattagacgatctagcactatattgcacaaactataaagtaaacgaagatatcttaaacaagatcaaagaaagtgaaaacatagataacattttcaatgacatacactttgtagaactactaccaaatttcaaagatcatctaatgttatcaacagaactaatcagaaaactaatcccaattatgtacggaggaaacacatacgataaagccatgaacatactgggttacaaccattcagacataaatggcgataaagaaaagaaagacttattagtacctatctgtgtagacgataatatcaccaatcaacgggtaatacgaagcctaacacaaacccgcaaagtaataaacagcataattaagaaatatgggatgccgaaaataataaacatagaaactgcaagagaattggcaaagtcaagacaagaacgcaacgaaattgccaaaaacaatgtagaaaaacaagcagaaaacgaaaagattaaaaaccaacttgtagaattaggactatttgtaagcaccgacaaaatatcaagtacagatttattgaaatataaactctggaaagaacaaaatgaattttgcgggtattcaatgaagaaaatatcaatagaagacctatttggaaacaacatcgtacaaatcgatcatattctaccgtacagccgaacgtataatgacaactatctaaataaaacattagtatacacaaaagaaaatcaagaaaaaggcaacagaaccccatatgaatggttcgggaaaacagataaatgggacgaatatgaaacttacataaataacctcacaatatcacaaaagaagaaagacaactacctcctaaagaaactagattttgataccgaaagagaaatgcgaagccaaaatctaaacgacacaaaatatatcagtaaagaactatcctcactaatcaaagcatacctaaacgtcgaaaaagtaaacatgtatcccggtgcaatcactgcaaaactccgagcccggtggggatttaacaggcttacacattcgtacctaagcaaaaactacatacttccgaaaaacataaaagaagacataaataaggatagagacaaccacctacaccacgccatggatgccttagtaatcgcgtcaataactccctcattacagcagaaaattaccctatacgaaaaattctcacgctatatagatgggcttacagaacttcagatcaaaaacatatcatacataaagatcgaagatagcgaaggacaatactataacgacgacaccgacgaagtcgaaacgatagacatcagagaatatataaaacaacaattagccgaaaacaacatctattataacaggcataacatatccaaactggagttcccattgccatatgaaaacttcgataaagaagcaaaacttagagtatatgaacaagacctagacacactaaaatggaatctaaaatcatataatacatatacacaaaaagatattgataatgttcacacactaataccatcaatagctaaaacaaaagtatccggaaagatgcatgaagaaacctactatggaataaaagaaataggaaaagacgaagataagaaaatctataaaaccctcagaacacccattgaaaaagtaaaaagaaaagacctcgataatataccagaccgcttgggtggttctaaagatgtatacgaatcattagtcgaatggtttggtgactacgaagttggggaagaagtactaaaagcgaacggaaataaatatccagttagcaaatcagacaaagaacacaaagaaatcaagaaactaaaactttactctgaatataaaaacactgggcatatgataaacaagtcaaatgtagaaaaaggcggaatatacagaatagacgtgttcaaaagcaaagacaaagaagacgacaaactctacttcgcagcatacgatatacttgaaattaagaaaatcaatactcttaaagagaaaaatagggtagacgacaacttcaacatcaaactagactacggacaaggtaaaaattcaaaaataatgtcgtatacagatatcatcaacaactatgatctatacataagcctcaacaaaaacgacctaatcaaaataacaaccaacgacggaaaagaaagtgtagcatacgttgttggatgcagtagcggaatgctagaagtaaaatccaaattaggcgacggatacgatataatcaaaacagatcttaacgaaaacaacattttctccaagcaaagagcgcaataccaaattacagtttcaaccatcaaagaaataaagaaattatccattagcgtactgggagaaatatccggcctatga

SEQ ID NO: 5200 - RNA, 3633 nt, synthetic construct
  misc_feature 1..3633: note = Cas9 variant
  source 1..3633: mol_type = other RNA
atgagaacaatattaggattagacctaggaactaactcaatcggatgggcggtaataaattccgttattaaagaacaaacagaaagaatatggatagagatggcaggatccagaattataccaatggacgcagcaatattaggtgactttgacaagggaaattccataagccaaacagcagaaagaacacgatttagaggtgtaagaagactaagagaaagacaattactaagacgagagagactccacaaagttctgaaaatactcggatttctacctgaacactacttaaaaggaattgacttcgagaaacatactggaaaattcctatcgggaagcgagccaaaactaccatgggtaaaagacagatggggcaaatatagttttttgtttcaaacagctttcaacgaaatgctagcagatttcgcaaaacatcaaccaagcctagttttcgatggtaagaaaataccctatgactggactgtgtattacctaagaaaaaaagcactgacggaaatgatcagcaaggaagaactggcatggatactgttgaacttcaaccaaaaaagaggatactatcaactcagaggagaagaagaagaagacaatgcaggtaaatcagtggaattttacgcacttaaagtcctatcagtagaagctacagacgaaaagaaaggaagagacatatggtacaatgtacacttggaaaacggatgggtatacaggcgaagtagcaatgttccattagattgggaaggacgagtaaaagaatttatagtaacaacagaccttaatcctgacggaacacccaaactagataaatatggtgaagtaaaaagatcatttcgagcgcctaaagaggatgattggatgcttattaaaaaaagaacagaagcagacataacaggtacacacaaaacgataggatcttacatctacgacgcgctgttacaagagcctcaacagaaaataataggcaaactagtaaaaacagtggaacgaaaattctacaaggaagaactcaacttcatcttacaaaagcagtgtgcatttcacgcagaactacaagatagggatctctacatgcgatgtatagaagctttatatccaggaaacgaagtacaaagacgaaatatcgccaaccgcgactttatatatttactaattgacgacgttttgttttaccaaagaccactaaaaacaaaaaaatcattaatagcaaattgcccttacgaagaaaacgaatacgtcaatcggaaaacaggcgaaataaaaacagcccctctaaaatgtatagctaaaagtcacccactgttccaagaatttcgcttatggtattttttatcgaacataagagtataccaaaaagaaagagaagtaaatggtacattacaccttgatgttgacgtaacgacagaattcttaaaaacagaggatgactacgtagcactatttgattggctaaactcccgaaaagagattgatcaaaaagccttcctaaggtaccctgcatttggactaaaaaaagaaataaataactataggtggaactatgtagaagataaattctacccatgcaacgaaacaagacatgctatactgagcagactcgaaaaagccggaattggaattgattttttgtctgatgaaaaagaaacagccttatggcacatcctatactctgtatctgacaagcaagaaatagaaaaagcactagcaacatttgccgtaaaaaacggcttaaacgaatcattcgtagaggttttcaaaaaattcccaccattcaagagcgaatacggagcctacagcgcaaaagcaataaaaaaattactaccattgatgagatgcgggaaatactgggatatgtcactaatagacggaacaacgaaagaaagaatagaaaggatcatagctggggaatgtgacgaaagtattggcgcaaaagttagagaaaaagcaatgaatttatccgacatatcctgttttaaacgtctaccactttggctagcatgctatgtcgtatacaatagacattcagaagataaggaaatcacaaaatgggaaacaccggcagacattgatgcatacttagcagccttcaaacaacatagcttacgtaatccaatagtcgaacaagtaattactgaaacactcagagtagtgagagatatatggaaacaagtgggaaaaatagatgagatacgaatagaactaggacgtgaaatgaaaaatccggcagacaaaagaaaaagaatgactactcaaatactagaaaacgaaaatgcaaatttaagaataaaagctctattagcagaatttgtcaacccagaatacggtgtggagaacgttagaccatactccccaagtcaacaagaaattctaagaatatatgaagatgcagtattaaaaggtgaagaacaaataccagaagacatcgacgttatcctaaaaaaatttaacactagcaaactcccaacgaaatccgaatttctccgatacaaattatggttagaacaaaaataccgtagtccctacaccggagaattaataccgcttgcaaagttattcacagctgcatacgaaattgaacatgtaattccgcaatcaagatattttgatgattcatttagtaacaaagtcatatgcgaatcagcagtcaacaagctgaaagataatcaattaggatatgaatttatcaagaatcaccacggacagaaagttgaggtaggttttgggaaaactgttgaaattttttcagtagactcatacgaaagattcgtaaaggagcaatacgcaaaaagtggaataaaaatgaaaaaacttctaatggacgatataccggaacaattcattgaacgccaactaaacgacagcagatatatatcaaaagtcgtaaaaggactactctccaacatagtacgagaaaaaaacgacagcggagaatatgaacctgaagcagtatcaaaaaatatattagtatgcaccggttcagtaacagacagactaaaaaaagactggggaatgaacgacgtatggaattcgatagtttcacctagatttgaacgcctaaatgccttaactgaaacacaatgttttggtcattgggaaaataaagacggcaaaaaagtatttcaaacagcagtaccattagagtaccaaaaaggtttctcgaaaaaaagaattgatcaccgacaccatgcaatggatgcaatcgttatcgcatgtgcaacaaggaatcatgtaaactacttaaacaacgaatcggcatcaagaaacgcaaaaatatccagatatgatctacaaagactattatgtgacaaaagtagaggagatggtaacggaaactataggtggataataaaaaaaccatggactacatttacgcaagatgcaagagaagctctatcaggaataatcgtcagtcttaaacaaaacctacgcatcatcaacaagacaaccaatatctatcaacactttgatgcaaacggaacacgagtctacgagaaacaaaaaataggagactcatgggctatacgaaaacccatgcacaaagatacagttttcggcgcggtcaatttaaggaaagcgttaataccgcaacattacaacttaactctatttataagtagttga

SEQ ID NO: 5201 - RNA, 3642 nt, synthetic construct
  misc_feature 1..3642: note = Cas9 variant
  source 1..3642: mol_type = other RNA
atggagaaaaggttaggtatagatgttgggactaacagcttaggttgggccatagtggaagtggacgatgaaggatgtacacttttagatagaggagtggatatatttcaagaaggtgtagctcgagagaaaaatcaggaaaaaccagcagttcaagatcgaacagatgctagagccttaagaagacattactttagacgaagattacgaaaaatagcactcctaagagtgctagtaagacatgacttatgcccagccctatcagaagaacaactaaacgcttggcaaggtaaaggaatttatccattagacgacgcatttataaggtggcaacgaacagatgacaatgcagaccgtaatccatatcgagatcgctttagatgtttaacagaagaattggatttggcatgtagagaagaaagatacgtactagggagagcactatatcacttatgtcaaaggagaggctttctttcaaacagaaaggatgcaggaaacgaagcagaagaaggaaaggttaaacaagaaattaaaactctcagtgcagatatggcagccgcagggtgtgaatacttaggagaatatttctacagactgtatcaaagaaaggaaaagattcgaaaacattatacagcaaggaacgaacactatttagctgagttcagagcgatctgtagaaaacaaagattagatgaagaattaaggcaggcattagaaaaggccattttctatcaacgacccttaaaaagtcagaaggggctagtaggtaaatgcacctttgaaaaagacaaaagtcgttgccccgtctcacacccaagatttgaagagttccgaatgctacaattcattaataatgtaagggtcacaggcccaggtgatgcagaaccaagacctttatcaccagaagaagttgaaatagtcagaccattgtttttaaggaaatcaaaacctcactttgactttgaagacatagcaaagaaaatagctggaaaaggaaattacgcatgcagaggcgaactgcttcaagccccctatagattcaattgtgcaggcaaatcgactgtaacaggaagtccagtttcagcgctatttgcaagcgtttttggagatgattggcaaagagaaatatgttcgctctatacactgggtgccggtaaaaatgaagaacaaatattaaatgatgtatggcacgtattatttgcatttgaagacgaagaaagattacaagcatggttacaggaaaaactacaattaagtgcagatgatgcaaaaaccctagccgcctttagattaccacaaggatacgcctctttgtccttaaacgtaataaacaaaatattaccatacttgcgaaggggttatagatatgacgaagctgtgttcttcgctaatttaggaaaggtcttaccagcggaagtatatgcggacccagcaaggcgaagagaagtagagcaaggaataagtgctcaaatggacgacctaggagatggagaaaagacaaggaaagaagaacgcataagagactatttaagaagatactggggcgtggaagagaaaagactcgaaagactctatcatccatcaatgatcgaggcttatccatctgcctcaccaaatgggcaaggattgttacaactcggttcaccgaggataccagcggtaaggaatccaatggcaatgcgcgctctttttagattaagggttttgctaaatgaattactcagagaaggtaaaattgatagaggaaccaaaataaatattgaattggcaagagaactaaacgacgccaataaacgaaaagcaatcgaacgataccaacgcgagcgggaagctgaaaaccgaaaatatgctgaggaaatacgacaacagtacgtagaggcaactggacactctatagaaccatcagaagaagatattttaaaatacaggttatgggtggagcagggacactgctcattatataccggcaaaactattggtattagtgaatttttaggagatggtaggcgatatgacatcgagcatacagtaccaagaagccggggaggagaagacgcacaatataacaaaactttatgcgaagaagaatttaatagagacattaaacgtgataaacttccaagtgaactagctaatcacactgcaatactcgcttgcgttgaaagttgcggatggttcgagcgaattgaaggacttgaacacagggtatggggagcagaccgccgcgcaaagtcagcgactaccaaaagtgcaaaagactttgcgatccaagacagacattactggagaatgcacttggactattggagacgaaagtgcgaagcatttacaatgacagaagtaccagaaggttttagcaatagacaaggagtagatgtgggtataatagggcgatatgcaagattatatttgcaaaccgtatttgacagagtatacacagtaaaaggggccactactgcagcatttagaaggatgtggggattacaagaggaatacgcggcaaaagaaagggtgaaccatgtccaccactgtatcgacgcgattacaatagcatgcataggatcaagagaatacgcactctgggcacaatatgtccgacaagacgaactctatcgatggggagaagcagataaaccaagatgcgggaaaccttggcctacattcacggaagatgtaagggcaaccgcagacgaattattaatatcgcatcatacgcctgataacatgcctaaacaaagcagaaaaagactaagagtgcggggcaaagtacaaagaaacgacagaggagaagtaaaatatatgcaaggagatactgctaggggagcattacaccaacaaacgttttatggtgcaatcgagagggacggagagataagatacgtagtgagaaaatccttagatcaattactacctgccgatgttgagaaaattgtagacgaagcggtaagacaaaaggttagagaagcggtagaggcttatggattcaaggaagcaactgaccccacaaaacacacagtttggatgaatgaggaaaaacaaataccaatacgaaaagttcgtattttaacaggggtgaaaaatcctatactattaaaacctcacagagacgtatcggtcaaagaatataaaagatattaccatgtcgtaaacgacggaaactattgcatggccatatacgaaggacgtgacagacaagggagactaaaacgaacgttcgagatagtaaataagctcgaagcagcccggtattttaaaagaagtgctgatcgagaatcaagacctgatctagtacccctctcagatgtcaacggatattcattaaaatatcttttaaagaccggaacaatggttctattctatgaaaactctccggatgaattatatgagtgttctgtaggagagctcgcgaaaagattatataaagtagtaggtatggcacaggacggtcgagtacaattcttgttccaccaagaagcaagagaccaaaaagctgttacagcagaatgtggaatggggatatccgtttttgatgcaagacatccggcgccaaagctaagaatcagagtgtcaaatttcaaaatgtttgtcgaaggttatgattttgaattaacagtaacaggagaggtaaaatttaaacgttga

SEQ ID NO: 5202 - RNA, 3642 nt, synthetic construct
  misc_feature 1..3642: note = Cas9 variant
  source 1..3642: mol_type = other RNA
atggaaaaacgattaggaatagacgtaggaacaaactcgttaggatgggcaatcgtagaagtagatgacgaaggatgtacgttacttgacagaggggtggatatctttcaagaaggagtagcacgagagaaaaatcaagaaaagcctgccgtacaagaccgaaccgatgcaagggctttacggagacattactttagacgacgtttaagaaaaatagcactcttacgagtattagttagacatgatctatgtccggcactaagtgaagaacaattaaacgcttggcagggtaaaggaatctacccgctagatgacgcattcattagatggcaacgaactgatgataacgctgatcgaaacccctatcgtgatagatttagatgtttaactgaggagttagacttagcatgcagagaagagagatacgtattagggcgagcattataccatttatgccagaggaggggatttttatcgaatcgaaaagacgcaggaaatgaagcagaagaaggtaaagtaaaacaagaaataaaaacactatcagctgatatggcagcagcaggatgtgaatatttaggagaatatttttatagattataccaaaggaaagaaaagattaggaaacattacactgcaaggaacgaacactatttggcggaatttcgggcaatatgtaggaaacaaagattagatgaagaattaagacaggcactagaaaaagcaatattttatcagagacctctaaagagtcaaaaaggtctagttggaaaatgtacatttgaaaaggacaaaagtagatgtccagtgtcacatcctagatttgaagagttccgaatgttacaattcataaacaacgttagggttactgggcctggcgatgcagaaccgaggccattatcgccagaagaggtagagattgtacgaccgttgttcttaaggaagagtaaactacattttgattttgaagatattgctaagaaaatagcaggaaaaggaaactatgcctgtagaggcgaactactgcaagcaccgtatagatttaattgcgccggaaaaagcacagtaacaggaagccctgtaagtgcattatttgcgagtgtattcggagatgattggcagcgggaaatatgttctctctacacactcggagccggaaagaatgaagaacagatcctaaatgatgtatggcatgttttatttgcttttgaagatgaagaacgactacaaacatggttacaagaaaaattgcaattgtctgcagacgacgcaaagaccctagctgcattcagattaccgcaaggttatgcgtcgttatcgttaaatgttataaacaaaatcctgccatatctaagacgaggctatagatatgacgaggcagtatttttcgcaaatttgggaaaagttctaccagcagaagtatatgcggacccagcaagaaggcgcgaagtagaacagggaatatctgcgcaaatggatgatttaggagatggagaacaaacaagaaaggaagaaagaataagagattatctacggaggtattggggagtagaagaaaaacgattagaaagactgtaccatccgagcatgatagaagcatatccgagtgcgtctccaaatggccaaggactcctccagttaggctctccgcgaataccagccgtaaggaacccaatggcgatgcgtgcattatttcgattgagggtactactaaacgagctactaagagaaggcaaaattgacagaggaaccaaaataaatatagagttggcaagggaattaaacgatgcaaataaaagaaaggcaatagaaaggtatcaaagagaaagggaggcagagaatagaaaatacgcagaagaaataagacagcaatacgtcgaagcaacaggtcatagtattgaaccatcggaagaggacatattaaaatatcggttatgggttgagcagggacactgcagtctttacacaggtaaaacaataggaatatctgaatttttaggggatggacgtagatacgatatagagcacacagtaccaagaagcagaggcggagaagatgcacaatataataaaacactttgtgaagaagagttcaatcgagatataaagcgggataaactacctagtgaactagcaaatcatacagcaattttagcatgcgtagaatcatgtggatggtttgaacgtatagaaggattagaacacagagtgtggggagctgatcgaagggctaaaagtgctaccacaaaatcagcgaaagattttgccatacaagatagacattactggagaatgcacctggactattggagacgtaaatgcgaagcgtttacaatgaccgaagttccggaagggttttcgaataggcagggtgttgacgttggcataataggccgatacgcaagattatatcttcaaacagtatttgatcgggtatatacagttaaaggagctaccactgcggcattccgtagaatgtggggtttacaggaagaatatgcggctaaggaaagggtcaatcacgttcatcattgtatagatgcgattacaattgcatgtataggatcgcgagaatacgcgttatgggctcaatatgttaggcaagacgaactttacagaagaggagaagcagacaaacctcgatgcggaaaaccatggcccacttttacagaggacgtaagagcaactgctgatgagttgcttatttctcaccatacaccagataatatgccgaaacagagtagaaagaggttaagagtacgaggtaaagttcagcgcaacgaccgtggggaagtgaaatatatgcaaggagacacagcaagaggtgccctccatcaacaaaccttctatggagcaatagaacgagatggggaaatcagatacgtagtgcgcaaatcgctagaccaattgttaccggcggatgtagagaaaatagttgacgaagcagtacgacaaaaagtacgagaggcggttgaagcatatggattcaaggaagcaacagatcctacgaaacatacggtatggatgaatgaagaaaaacaaataccaatcagaaaagttcggatacttacgggagtaaagaacccaatattattgaaaccacatagggacgtctctgtaaaagaatataagagatattaccatgttgttaacgatggaaattattgcatggcgatatacgaaggtagagatagacaaggaagactaaaaaggacattcgaaatcgtaaacaaacttgaggcggccagatactttaagagaagcgcggacagagaatccagaccggatttggttcctttaagtgatgttaacggatatagtctaaaataccttttaaaaacaggaaccatggtactattttacgaaaattcaccagacgaactttacgaatgttcagtgggcgaattagcaaagaggctatataaagtagttggaatggcacaagatggaagagtacaatttttatttcaccaagaggcaagagatcaaaaagccgtaaccgcagagtgtggaatgggaatatcagtatttgatgcgcgacacccagcaccaaaactaagaataagggtatctaacttcaaaatgttcgtcgaaggatacgattttgaactaactgtaacgggggaagtaaaatttaagagatga

SEQ ID NO: 5203 - RNA, 3651 nt, synthetic construct
  misc_feature 1..3651: note = Cas9 variant
  source 1..3651: mol_type = other RNA
atgaccaaaattctaggaattgatactggcacaaactcactaggatgggcaattgtcgataaaacagccgataactacaatctactagataaaggtgtcaacattttccaggaaggagtaaaaatagaaaaaggaatcgaatcaagtaaagcagcagagagaacagaacacagagcaaccagagtgagatattacagaataaaattgagaaaaattagactactaaggatattatcagataaccacctatgcccccctttgagtcaagaagaactatcaacatggcgtttaaaaaaagtatacccaaagaatgaacttttcatgcagtggcaaagaacagacgatgatacagaaaaaacaccatatgcatatagacataaatgtatacacgaaaagctagacttaagcgatgtaaccgatcgttacatattaggaagggcattctatcatataatacaaagaagagggtttctcagcaacagaaaagaacaagggggcgaagattcaggaaaagtgaaagaaggcatatcaactttaacacatgaaatgaacgaggccggctacgaatacctcggtgactacttttacgcattatacaataaaggcgaaaaaattagaaaacattatacagcgcgaaatgaacatttcttatcggagtttaaagcaatatgcgaaaaacaagatttagagaaagaactcggatcagaagtagtaagaaacatcgaaaaagccatatttgatcaaaggccattaaaatcacaaaaaggacaagtaggaaaatgcgtatttgaaaaaaacaagactaaatgcccatcatcgcatcccatgtatgaggaattcagaatgttaacattcataaacaatatcaaaatcaagacaccaaacgacgatgtcttacgaccattaaacacaggagaacgtgaaaaaataatgccattattctttagaaaaagtaaaaaacaatttgacttcgaggatatcacaaaaaaacttgcaccaaaaaaaatgtatggattctataagaaagaagaagacgccgaaatgccatttctattcaactaccctatggacacctcggtatcggggtgtccagtcacagcagcattaaaagacgtgtttggagacgactggataacagcgatatgtgaaacatatacattaggagagggtaaaagcagattcgatattgtgaacgatatttggcatgcactatatttctatagtgacaaggacaaacttgcagaatttgcaataaataggctccaattaagtgaggatgaagctaaaatcttttcagaaatttccctacccgcagactacgcttccttatcattaaaagcaatttgtaagatactaccatacttaagaagaggcttaatatactctcatgctgtattcttaggtaacctgtgcgaagtaatgccaaaatacgaatggagcataaaagaaatgagagaaacaatcatagataacataatcatggaaatggacaaatgcgatacaaaagacaaaaggacatttgaagtatgtataaaagattatttaaaaggacaatataatgtttccgataattcgctaaaaaaactataccatccttcaatgattgaaacttatcctcgcgttcaatacactaacgaacacggagtttaccaactaggaagtccaagaatagatagtgtcagaaatccaatggcaatgagatcaatgtttagactaagaaaactagtaaatagacttttagttgaaggtaaaatagatcaaaatacagaagttcatattgaattcgcccgagaactaaatgatgcgaataaaagaaacgcaatcgctctgttcgttaaagaaaaccaatctgcaaacgatgaggcaagaaaacaaatcataactttatttaaaaaggaaacaggaaccgacatagaaccaacggacaaagacatactaaaatatgtactttgggaagaacaaaatcacatatgtttatacactggtaaacaaataagaataagtgatttcataggagcgaatccaaaatttgatatagaacatacaataccaagaagcgtaggcggagactccactaaaatgaatcttactctatgcgattcccgttttaatagagaagtaaaaaagacaaaactaccagtcgagcttccaaatcatgacgaaataatggaaagaattaaagaatggaaaaaaaactatgaattactagatattcagatccgcaaaaataaaaaattatcaaaaggcgcaacaacaaaagaacaaaaagatacaattataagaaaaagacatttattggaactaagaagagactactggagaggcaaatatgagaggtttacaatggaatcagtccctgaaggattcagtagaagacaaggaacagatatatcagtgataagtaaatacgccagattatatctaaaatccttatttaacagggtttataccgttaaaggaattgcaacgtctgattttcgaaaaatatggggtattcaagacatatacagcaaaaaagaaagaataaatcatgtccatcactgcatcgacgccatagtcatcgcgtgtatcggtttagatgaatacaacaaacttggagcatactaccacgacgaagagaacaataaatggtacgggatgtcaaaagcttcatttaaaaaaccttgggcaacattcgtagaagatatcaaaaaaattcaagacgagattttagtctatcattatactcccgacaacatgccaaaacaaggacggaggagaataaaaatagacggaaaaaaaatattatgcaaaggtgacgccgcaaggggttcactgcataatgacacatactacggtgccattgaaaatgacggagcagtaaaatacgtcaaaaggattgacctagcaagcttggaggagaaggacgtaaagaatattgttgatgacactgtacgctctattatagaagccgctataaaagaaaaaggcttcaaagatgcaatggcaagcacaatatggatgaatgaagaaaaacgagtaccaataaaaaaagtcagatgttttaccccaagcataactaaaccattaaacatacgaaaacaaagagatgtatcaataaaagaatacaagcaacaataccatgtagcaaacgactcaaattatcttctcgcactatacattggcacagacaataaaggaaaggaaaaaagagagttcgaaatcgtaaatattctacaagcagcacaatactaccgaacgtccaacgacaaagaggtcgtagacagacatatagttccgataaaaagcgaacatgactatccttttgcttacaccctaaaaattggcaccatggtcctattatacgaaaaatcacctaatgaagtttgggacgcaacgatcaaggaacgaaacagaagattatataaggtcaccggcctctcaactatgagaatgaaagggagaaacggtgaatacgcttatgcaacagtgaaattaattcataatgaagaagcaagaccctctaaagatatcaaagcaaaaaatggcgaatacgagcaaggagaagaattcagaccggcaataattatgttacacactcaattaaacgcactagttcaagggtatgactttgaaataaatgagctaggagaaatcagaagactaagatga

SEQ ID NO: 5204 - RNA, 3654 nt, synthetic construct
  misc_feature 1..3654: note = Cas9 variant
  source 1..3654: mol_type = other RNA
atggaaaaacaaagaatattaggtctggatccaggaacaaactcactagggtgggctgtcttggacttcgacaatagcaaacaggaatacaatctagtaagaaaaggcgaagtaatctttgaagaaggagtgggaaaatccgagaggggagaattttcaaaggcggcgtaccgaacattctacaaatcaacaagaaaacactatttcagacgaagactcagaaaaatagaagtcttgaaagtactagtaaaatatgatttctgcccctatttatctgacgacttactaaaacaatggcatgaaaaaaaaatatatccggcagttaaagaattcatggactggcaacgcacatccgacgctgaaggtaagaacccatactatgataggcactgttgcttaaacgaaaaattagatctatctctcaagagcgatagatacatattaggacgagctctctaccatttaacccaacgaagaggctttaaatcaaatagattaatacaaaataacgacgaaaatgaagaaggaaaagtaaaaaaaggcatcagcgaattatcaactgaaatgcaagaagcaaactgtaactacctaggcgactacttctacaaattatatacagaaaaaggaaacaccgtacagatccgcaaaagatacaccgacagagaaaaacattacaaaaacgagttcaatgcaatctgtgaaaaacaagagctaaatgaaacgatagtcaaagaattagataaagccatattttttcaacgaaagttaaaaccacaaagacacggagtaggaaaatgcaccttcgaacccaacaacaggcgttgtgccattagtcatcccgattttgaaagattccgaatgttatgcttcatcaataatataaaaatcaaaacacctttcgaagaaaatctcagaccattaaacaacgaagagaaagcgttaatagaaccactgttctacaggaaaagtataaaaaacttcgacttcgaagaaatagccaaaaaacttgcgggaaaaaataactattgctacatcaaagacgacagctccaaacagtacaaatttaattacagaatgtcccaaggcgcaagcacctgccaaacaatagccaaactaaaatcaatattcggagaagaatggaaaaacggaatagcagaaacatatactaacagaagaaaaaaggaagggttaaaaaaacaagcagaaatggtggatgatatctggaacgtcttatattccgtctctgaatgcgatgtccttaaagacttcgcaataaataaattacaattagatgaaaaaaccgcggataacttctcaaaaacaaaattggcacaaggattcgcaacattatctttaaaagcaataagaaaaatactacctttcttagaacaagggttcggctatacagaagccgtattcctagcaaatattccaacggtcgtcggcaaagaatattggaataacgaagacataagaaatgacataatggaggaaataaaaacaatattttaccataacacactcaaaacaaatgactcacacaatacaatcctcttctgcattaaagacatactaagcaataactttgacttagcacccggagccatcgacaagctataccatccgtccatgataaatgtatacaaagatgtcatacctaacgaagatggaatattacagttaggatctccaaaaatagatgcagtaaaaaacccaatggcaatgcgtagtctacacataattcgtaaagtcgtaaacgaactattacgagaggggataataaactcagacacagaagtgcgaatagagtacgcaagagagctaaacgatgccaataaaagacacgctattgccgactggcagaaaaaacagtatgggaaacaccaaaaataccgtaaggagataaaagaattattcaaagcagaaactggttttgaaatagaaccaaacgaaacagacatccttaaattcgaattatgggaagaacaaaaccatatatgtttgtacactggtcaagagataggaataagcgaattcgtaggagaaaacccgaaatatgatattgagcacactttcccaagaagcctaggaggagactcaacaaaaatgaacatgaccctatgcgaaaacaagtttaatagagaaaacaaacaaaaaaaacttccaagtgaactagctaaccactctgaaattctagaacgaattgatgattggaaaaaaaaaatatatatcttacaaaaaaaatatgacagtatacgaacacacaacggaatggacaaagaaaataaagacaaaaaaatagttagccgacacaaaattaaattagaattagattactggaaaggaaaatataaccgcttcacgatgacagaaataccagaaggattctctagacgtcaaggcatgggaatcggattaatatcgagatacgcgggtctttatcttaaaacaatatttcataaaaaggacaacccacaaaaatcaaatgtatacatagtaaaaggaagcataaccgctgaatttagaagaatatggaacatacaagacgactacgagaaaaaatgcagagataatcacatacatcattgtatagatgctatagtcgttggatgcataggaaaacgcgaatacgacttaatggctcagttctatagagatgaagaaaaatatagatgggaaaaaaagaaaaaacctttctttaaaaaaccctgggaaactttcactcaagatatgctctccctaaaagacgaagtattgacagtacatttcaatccatcaaattttacaaaaaaagcacataaaaaagtgttcacgccaaagggaatattcgtagcccaaggcgattgcgcaagagtaaaacttcacaagggtagttactttggagccattgagcaaaaaggcgaaattaaatacgtaatgcgaaaagaactaagtgcattaaaaatagaagatataaaaaatatagtagacgccgtcgtaaaagaaaaagttctagctgtagtaaaaaaaaaaggtttcaagcaagccatggcagaaccaatatacatgaatgaagacaaaagaatactaattaaaaaagtacgactgttcgtaagtcaagctaatccactaatagtgaaaaaacacagagacttatcatcgaaagaatataaacaaaactactacgttgacaatgaaggtaatctcatgattgccatgtacgaaggtgtaaaaaaaaacggaaaaatagacagggaaatcacagttgtcaacaatctagaggctgccaaatttttccgtcagagtcaaaaaaacaacgcggaaaaacagctaatatctcacctatctcctaaaaacggttaccccttaaaaaccgtcctaacccaaaaacaactagtccttatgtacgaagacagccctaaagaaataaaactccgggacacaaaaaacatggtaaaaagattatatcaagtatttggaatagaaaaagacggcagggtaaagttaaaatttcaccaagaagccagatcagaaggtttaaacataaacagcgccgcattcaaaattcaagatacacctgaatcactatatcgacatacaaaaagcaacctaaaagtactagtcaacggagtagatttcaaaatcaacatattaggcgaaataagcctaatttga
